US007393540B2

(12) United States Patent
James et al.

(10) Patent No.: US 7,393,540 B2
(45) Date of Patent: Jul. 1, 2008

(54) MYCOBACTERIAL ANTIGENS EXPRESSED DURING LATENCY

(75) Inventors: Brian William James, Salisbury (GB); Philip Marsh, Salisbury (GB); Tobias Hampshire, Salisbury (GB)

(73) Assignee: Health Protection Agency, Salisbury (GB)

( * ) Notice: Subject to any disclaimer, the term of this patent is extended or adjusted under 35 U.S.C. 154(b) by 0 days.

(21) Appl. No.: 10/482,706

(22) PCT Filed: Jul. 4, 2002

(86) PCT No.: PCT/GB02/03052

§ 371 (c)(1), (2), (4) Date: Jul. 19, 2004

(87) PCT Pub. No.: WO03/004520

PCT Pub. Date: Jan. 16, 2003

(65) Prior Publication Data

US 2004/0241826 A1 Dec. 2, 2004

(30) Foreign Application Priority Data

Jul. 4, 2001 (GB) ................................ 0116385.6
Oct. 5, 2001 (GB) ................................ 0123993.8

(51) Int. Cl.
*A61K 39/04* (2006.01)
*A61K 39/02* (2006.01)
*A61K 39/00* (2006.01)

(52) U.S. Cl. .................... 424/248.1; 530/300; 530/350; 424/9.1; 424/9.2; 424/184.1; 424/185.1; 424/190.1; 424/234.1

(58) Field of Classification Search .................. 424/9.1, 424/9.2, 184.1, 185.1, 190.1, 234.1, 248.1; 530/300, 350
See application file for complete search history.

(56) References Cited

U.S. PATENT DOCUMENTS 6,183,957 B1 2/2001 Cole et al.
6,613,553 B1 * 9/2003 Rock et al. .................. 435/189

FOREIGN PATENT DOCUMENTS

| | | | |
|---|---|---|---|
| WO | WO 92/08484 | | 5/1992 |
| WO | WO 94/01441 | | 1/1994 |
| WO | WO 97/35611 | | 10/1997 |
| WO | WO 98/53076 | A2 | 11/1998 |
| WO | WO 98/55624 | | 12/1998 |
| WO | WO 99/04005 | | 1/1999 |
| WO | WO 99/10536 | | 3/1999 |
| WO | WO 99/24067 | | 5/1999 |
| WO | WO 99/57130 | | 11/1999 |
| WO | WO 00/52139 | | 9/2000 |
| WO | WO 02/077183 | A2 | 10/2002 |

OTHER PUBLICATIONS

Daniel, T.M., "Soluble Mycobacterial Antigens", in, The Mycobacteria, a sourcebook, Part A, eds. Kubica and Wayne, Marcel Dekker, Inc., New York, pp. 417-465, 1984.*

Stedman's Medical Dictionary, $26^{th}$ edition, Williams & Wilkins, Baltimore, MD, 1995, p. 868.*

Betts, J.C., et al., "Evaluation of a nutrient starvation model of *Mycobacterium tuberculosis* persistence by gene and protein expression profiling," *Mol. Microbiol. 43*:717-731, Blackwell Scientific Ltd (Feb. 2002).

Blanton, R., et al., "A 60K Protein is Induced by *Mycobacterium Avium* Intracellulare by Nutritional Deprivation and Heat Shock," *Clin. Res. 38*:553A, Charles B. Stack (1990).

Cole, S.T., et al., "Deciphering the biology of *Mycobacterium tuberculosis* from the complete genome sequence," *Nature 393*:537-544, Nature Pub. Group (1998).

Cole, S.T., et al., "Deciphering the biology of *Mycobacterium tuberculosis* from the complete genome sequence (Erratum)," Nature 396:190-198, Nature Pub. Group (1998).

DeMaio, J., et al., "A stationary-phase stress-response sigma factor from *Mycobacterium tuberculosis,* " *Proc. Natl. Acad. Sci. 93*:2790-2794, National Academy of Sciences (1996).

Gupta, S., et al., "Proteomics analysis of carbon-starved *Mycobacterium smegmatis*: Induction of Dps-like protein," *Protein Eng. 15*:503-511, Oxford University Press (Jun. 2002).

Hutter, B., and Dick, T., "Analysis of the dormancy-inducible *narK2* promoter in *Mycobacterium bovis* BCG," *FEMS Microbiol. Letts 188*:141-146, Elsevier Science B.V. (Jul. 15, 2000).

Mahenthiralingam, E., et al., "Cloning and sequencing of the gene which encodes the highly inducible acetamidase of *Mycobacterium smegmatis,"J. Gen. Microbiol. 139*:575-583. SGM (1993).

Michele, T.M., et al., "Exposure to Antibiotics Induces Expression of the *Mycobacterium tuberculosis sigF* Gene: Implications for Chemotherapy against Mycobacterial Persistors," *Antimicrobial Agents and Chemotherapy 43*:218-225, American Society for Microbiology (1999).

(Continued)

*Primary Examiner*—Rodney P Swartz
(74) *Attorney, Agent, or Firm*—Sterne Kessler Goldstein & Fox P.L.L.C.

(57) ABSTRACT

A method is provided for identifying mycobacterial genes that are induced or up-regulated under culture conditions that are nutrient-starving and which maintain mycobacterial latency, said conditions being obtainable by batch fermentation of a *micobacterium* for at least 20 days post-inoculation, when compared with culture conditions that are not nutrient-starving and which support exponential growth of said *mycobacterium*. Said induced or up-regulated genes form the basis of nucleic acid vaccines, or provide targets to allow preparation of attenuated *mycobacteria* for vaccines against mycobacterial infections. Similarly, peptides encoded by said induced or up-regulated genes are employed in vaccines. In a further embodiment, the identified genes/peptides provide the means for identifying the presence of a mycobacterial infection in a clinical sample by nucleic acid probe or antibody detection.

17 Claims, 4 Drawing Sheets

OTHER PUBLICATIONS

Murugasu-Oei, B., et al., "Upregulation of stress response genes and ABC transporters in anaerobic stationary-phase *Mycobacterium smegmatis*," *Mol. Gen. Genet. 262*:677-682, Springer-Vertag (1999).

Rivera-Marrero, C.A., et al., "Identification of genes differentially expressed in *Mycobacterium tuberculosis* by differential display PCR," *Microb. Pathog 25*:307-316, Academic Press (1998).

Sambrook, J., et al., eds., *Molecular Cloning: A Laboratory Manual, 2nd Edition*, Cold Spring Harbor Laboratory Press, Cold Spring Harbor, NY, pp. 8.48-8.49 (1989).

Sherman, D.R., et al., "Regulation of the *Mycobacterium tuberculosis* hypoxic response gene encoding α-crystallin," *Proc. Natl. Acad. Sci. 98*:7534-7539, National Academy of Sciences (Jun. 19, 2001).

Smeulders, M.J., et al., "Adaptation of *Mycobacterium smegmatis* to Stationary Phase" *J. Bacteriol. 181*:270-283, American Society for Microbiology (1999).

Yuan, Y., et al., "The 16-kDa α-crystallin (Acr) protein of *Mycobacterium tuberculosis* is required for growth in macrophages," *Proc. Natl. Acad. Sci. 95*:9578-9583, National Academy of Sciences (1998).

Dialog File 351, Accession No. 9728887, Derwent WPI English language abstract for WO 94/01441 (Document AM1).

NCBI Entrez, GenBank Report, Accession No. P71591, from Cole, S.T., et al. (1998).

Search Report under Section 17(6) for Application No. GB 0116385.6, The Patent Office, United Kingdom, mailed May 29, 2002.

EBI Accession No. AAW73663, Alderson, M.R., et al., "M. tuberculosis antigen clone Tb436 protein sequence" (First entered Mar. 24, 1999).

EBI Entry, Accession No. ABU34862, Wang, L., et al., "Protein encoded by Prokaryotic essential gene #20389" (First entered Jun. 19, 2003).

EBI Entry, Accession No. ABU36420, Wang, L., et al., "Protein encoded by Prokaryotic essential gene #21947" (First entered Jun. 19, 2003).

UniProt Accession No. O53633, Cole, S.T., et al., "UniProtKB/TrEMBL entry O53633" (First entered Jun. 1, 1998).

Primm, T.P., et al., "The Stringent Response of *Mycobacterium tuberculosis* Is Required for Long-Term Survival," *J. Bacteriol. 182*:4889-4898, American Society for Microbiology (Sep. 2000).

* cited by examiner

MYCOBACTERIAL ANTIGENS EXPRESSED DURING LATENCY

CROSS-REFERENCE TO RELATED APPLICATIONS

This application is the U.S. National Phase of International Publication No. WO 03/004520 A2, filed as PCT/GB02/03052 on Jul. 4, 2002, which claims priority to GB 0116385.6, filed Jul. 4, 2001, and GB 0123993.8, filed Oct. 5, 2001.

The present invention relates to a method of identifying a gene in *mycobacteria* the expression of which is induced or up-regulated during mycobacterial latency, to the isolated peptide products, variants, derivatives or fragments thereof, to antibodies, that bind to said peptides, variants, derivatives or fragments, to DNA and RNA vectors that express said peptides variants, derivatives or fragments, to attenuated *mycobacteria* in which the activity of at least one of said induced or up-regulated genes has been modified, to vaccines against mycobacterial infections, and to methods of detecting the presence of a mycobacterial infection.

Many microorganisms are capable of forming intracellular infections. These include: infections caused by species of *Salmonella, Yersinia, Shigella, Campylobacter, Chlamydia* and *Mycobacteria*. Some of these infections are exclusively intracellular, others contain both intracellular and extracellular components. However, it is the intracellular survival cycle of bacterial infection which is suspected as a main supportive factor for disease progression.

Generally, these microorganisms do not circulate freely in the body, for example, in the bloodstream, and are often not amenable to drug treatment regimes. Where drugs are available, this problem has been exacerbated by the development of multiple drug resistant microorganisms.

A number of factors have contributed to the problem of microbial resistance. One is the accumulation of mutations over time and the subsequent horizontal and vertical transfer of the mutated genes to other organisms. Thus, for a given pathogen, entire classes of antibiotics have been rendered inactive. A further factor has been the absence of a new class of antibiotics in recent years. The emergence of multiple drug-resistant pathogenic bacteria represents a serious threat to public-health and new forms of therapy are urgently required.

For similar reasons, vaccine therapies have not proved effective against such intracellular microorganisms. Also, increased systemic concentration of antibiotics to improve bioavailability within cells may result in severe side effects.

*Mycobacterium tuberculosis* (TB) and closely related species make up a small group of *mycobacteria* known as the *Mycobacterium tuberculosis* complex (MTC). This group comprises four species *M. tuberculosis, M. microti, M. bovis* and *M. africanum* which are the causative agent in the majority of tuberculosis (TB) cases throughout the world.

*M. tuberculosis* is responsible for more than three million deaths a year world-wide. Other *mycobacteria* are also pathogenic in man and animals, for example *M. avium* subsp. *paratuberculosis* which causes Johne's disease in ruminants, *M. bovis* which causes tuberculosis in cattle, *M. avium* and *M. intracellulare* which cause tuberculosis in immunocompromised patients (eg. AIDS patients, and bone marrow transplant patients) and *M. leprae* which causes leprosy in humans. Another important mycobacterial species is *M. vaccae.*

*M. tuberculosis* infects macrophage cells within the body. Soon after macrophage infection, most *M. tuberculosis* bacteria enter and replicate within cellular phagosome vesicles, where the bacteria are sequestered from host defences and extracellular factors.

It is the intracellular survival and multiplication or replication of bacterial infection which is suspected as a main supportive factor for mycobacterial disease progression.

A number of drug therapy regimens have been proposed for combatting *M. tuberculosis* infections, and currently combination therapy including the drug isoniazid has proved most effective. However, one problem with such treatment regimes is that they are long-term, and failure to complete such treatment can promote the development of multiple drug resistant microorganisms.

A further problem is that of providing an adequate bioavailability of the drug within the cells to be treated. Whilst it is possible to increase the systemic concentration of a drug (eg. by administering a higher dosage) this may result in severe side effects caused by the increased drug concentration.

The effectiveness of vaccine prevention against *M. tuberculosis* has varied widely. The current *M. tuberculosis* vaccine, BCG, is an attenuated strain of *M. bovis*. It is effective against severe complications of TB in children, but it varies greatly in its effectiveness in adults particularly across ethnic groups, BCG vaccination has, been used to prevent tuberculous meningitis and helps prevent the spread of *M. tuberculosis* to extra-pulmonary sites, but does not prevent infection.

The limited efficacy of BCG and the global prevalence of TB has led to an international effort to generate new, more effective vaccines. The current paradigm is that protection will be mediated by the stimulation of a Th1 immune response.

BCG vaccination in man was given orally when originally introduced, but that route was discontinued because of loss of viable BCG during gastric passage and of frequent cervical adenopathy. In experimental animal species, aerosol or intratracheal delivery of BCG has been achieved without adverse effects, but has varied in efficacy from superior protection than parenteral inoculation in primates, mice; and guinea pigs to no apparent advantage over the subcutaneous route in other studies.

There is therefore a need for an improved and/or alternative vaccine or therapeutic agent for combatting mycobacterial infections.

An additional major problem associated with the control of mycobacterial infections, especially *M. tuberculosis* infections, is the presence of a large reservoir of asymptomatic individuals infected with *mycobacteria*. Dormant mycobacteria are even more resistant to front-line drugs.

Infection with *mycobacteria* (eg. *M. tuberculosis*) rarely leads to active disease, and most individuals develop a latent infection which may persist for many years before reactivating to cause disease (Wayne, 1994). The current strategy for controlling such infection is early detection and treatment of patients with active disease. Whilst this is essential to avoid deaths and control transmission, it has no effect on eliminating the existing reservoir of infection or on preventing new cases of disease through reactivation.

Conventional mycobacterial vaccines, including BCG, protect against disease and not against infection. Ideally a new mycobacterial vaccine will impart sterile immunity, and a post-exposure vaccine capable of boosting the immune system to kill latent *mycobacteria* or prevent reactivation to active disease-causing microorganisms would also be valuable against latent infection.

Conventional detection of latent mycobacterial infection by skin testing may be compromised. For example, current TB detection methods based on tuberculin skin testing are compromised by BCG vaccination and by exposure to environmental *mycobacteria*.

New strategies are therefore required for more effective diagnosis, treatment and prevention of mycobacterial latent infection.

To develop specific strategies for addressing latent mycobacterial infection it is necessary to elucidate the physiological, biochemical and molecular properties of these microorganisms.

At present, there is no suitable in vivo model for studying mycobacterial latent infection and such a model is unlikely to provide sufficient microbial material to enable detailed analysis of the physiological and molecular changes that occur.

Studies to date have used either static cultures which allow tubercle *bacilli* to generate oxygen-depletion gradients and enter a non-replicating persistent state in the sediment layer, or agitated sealed liquid cultures (Wayne and Lin, 1982; Cunningham and Spreadbury, 1998; Wayne and Hayes, 1996). Transition to a non-replicating persistent state in these models coincides with a shift-down to glyoxylate metabolism, resistance to isoniazid and rifampicin and susceptibility to the anaerobic bactericidal action of metronidazole (Wayne and Hayes, 1996).

For example, a number of publications have described the analysis of mycobacterial gene and protein expression profiles following exposure of the mycobacteria to various environmental stimuli. These include Sherman, D. R. et al (2001) PNAS, vol. 98, no. 13, pp.7534-7539; Hutter, B. (2000) FEMS Microbiol. Letts. 188, pp. 141-146; Michele, T. M. et al. (1999) Antimicrobial Agents and Chemotherapy, vol. 43, no. 2, pp. 216-225; Yuan, Y. et al. (1998) PNAS, vol. 95, pp. 9578-9583; Boon, C. et al (2001) J. Bacteriol., vol. 183, no. 8, pp. 2672-2676; Cunningham, A. F. et al (1998) J. Bacteriol., vol. 180, no. 4, pp. 801-808; Murugasu-Oei, B. et al (1999) Mol. Gen. Genet., vol. 262, pp. 677-682; and a number of patent publications such as WO99/24067, WO99/04005, WO97/35611, and WO92/08484. The *mycobacteria* employed in these analyses have been grown in crude, batch systems, with the result that there is little or no control of the environmental stimuli to which the mycobacteria have been exposed. Accordingly, the bacteria experience a large number of complex, interactive environmental stimuli, some of which may have rapid and transient effects in terms of gene and protein expression.

Such studies are poorly defined and controlled; and experiments relying on self-generated oxygen-depletion gradients have yielded inconsistent results. In addition, the described studies have been conducted over a relatively short duration in terms of post-inoculation growth, in many cases up to approximately 2 weeks post-inoculation, with the result that the cultured bacteria are exposed to environmental stimuli associated with the mid to late exponential phase, and/or the early stationary phase.

In view of the above, there is a need for a defined and controlled model for studying mycobacterial (eg. TB) persistence which simulates key features of the in vivo environment.

According to a first aspect of the present invention there is provided an isolated mycobacterial peptide, or a fragment or derivative or variant of said peptide, wherein the peptide is encoded by a mycobacterial gene the expression of which is induced or up-regulated under culture conditions that are nutrient-starving and which maintain mycobacterial latency, said conditions being obtainable by batch fermentation of a *micobacterium* for at least 20 days post-inoculation, when compared with culture conditions that are not nutrient-starving and which support exponential growth of said *mycobacterium.*

Latency is synonymous with persistence. These terms describe a reversible state of low metabolic activity in which mycobacterial cells can survive for extended periods without cell division.

In contrast to the various prior art analyses, the present invention is concerned with the induction or up-regulation of mycobacterial genes (and the corresponding gene products) during long term latency conditions rather than during the onset of latency (ie. late exponential phase, or early stationary phase).

The preferred culture method of the present invention is that of batch fermenter culture. This method permits careful monitoring and control of growth culture parameters such as pH, temperature, available nutrients, and dissolved oxygen tension (DOT). In particular, temperature and DOT may be strictly controlled. In contrast, careful monitoring and control is not possible with convention, crude batch culture systems, with the result that *mycobacteria* cultured by such systems are exposed to a multiplicity of complex, interactive environmental stimuli, some of which may have rapid and transient effects in terms of gene and protein expression. Thus, the batch fermenter system of the present invention allows relatively careful control of environmental stimuli so that a mycobacterial response to a particular stimulus (eg. nutrient starvation) can be analyzed in relative isolation from other environmental stimuli that may otherwise obscure or modify the particular mycobacterial response of interest.

In use of the present method it is possible to ensure that the principal latency induction parameter employed is starvation of carbon, and preferably the starvation of carbon and energy. This means that the accidental induction or up-regulation of genes that are solely responsive to other environmental switches may be substantially prevented. Accordingly, false-positive identification of genes that are induced or up-regulated under conditions unrelated to carbon; starvation and/or energy limitation may be substantially avoided.

The term "nutrient-starving" in the context of the present invention means that the concentration of the primary carbon, and preferably the primary energy source, is insufficient to support growth of the *mycobacteria*. "Nutrient-starving" is a term associated with an established mid to late stationary phase of a batch culture growth curve. Under such conditions the *mycobacteria* are metabolically stressed, rather than simply reduced in growth rate.

In more detail, exponential growth is that period of growth which is associated with a logarithmic increase in mycobacterial cell mass (also known as the "log" phase) in which the bacteria are multiplying at a maximum specific growth rate for the prevailing culture conditions. During this period of growth the concentrations of essential nutrients diminish and those of end products increase. However, once the primary carbon and/or primary energy source falls to below a critical level, it is no longer possible for all of the mycobacterial cells within the culture to obtain sufficient carbon and/or energy needed to support optimal cellular function and cell division. Once this occurs, exponential growth slows and the *mycobacteria* enter stationary phase. Thereafter, the mycobacteria become nutrient starved, and enter latency. It is this latent state in the growth phase, rather than the late exponential phase or early stationary phase, with which the present invention is concerned.

Carbon starvation refers to a growth state in which the concentration of exogenous carbon is insufficient to enable the bacteria to grow and or replicate. However, when in this state, there may be other energy sources. (eg. endogenous reserves, secondary metabolites) that are available to maintain essential cellular functions and viability without supporting growth. Thus, carbon starvation is associated with a mid or late stationary phase condition in which the exogenous carbon source has become depleted and bacterial growth has substantially ceased. In terms of a batch fermenter culture of *mycobacteria*, this typically occurs at 20 days (or later) post inoculation.

The onset of stationary phase vis-a-vis the time of inoculation will depend on a number of factors such as the particular mycobacterial species/strain, the composition of the culture media (eg. the particular primary carbon and energy source), and the physical culture parameters employed.

However, as a guide, the end of exponential phase and the onset of stationary phase generally corresponds to that point in the growth phase associated with the maximum number of viable counts of *mycobacteria*.

In use of the present invention, the exponential phase mycobacterial cells are harvested from the culture vessel at a point in the growth phase before the maximum number of total viable counts has been achieved. This point in the growth phase may be mimicked under continuous culture-conditions employing a steady state growth rate approximating $\mu_{max}$ and providing a generation time of approximately 18-24 hours. In a preferred embodiment, the exponential phase mycobacterial cells are harvested when a value of between 2 and 0.5 (more preferably between 1 and 0.5) log units of viable counts per ml of culture medium less than the maximum number of viable counts per ml of culture medium has been achieved. Thus, the “exponential” phase cells are generally harvested during mid-log phase.

For example, if the maximum viable count value is $1\times10^{10}$ per ml, then the “exponential” phase cells would be preferably harvested once a value of between $1\times10^{8}$ and $1\times10^{9.5}$ (more preferably between $1\times10^{9}$ and $1\times10^{9.5}$) viable counts per ml has been achieved. In the case of *M. tuberculosis*, this would be approximately 3-10, preferably 4-7 days post-inoculation.

In use of the present invention, the nutrient-starved, batch fermenter cultured mycobacterial cells are harvested from the culture vessel at a point in the growth phase after the maximum number of total viable counts has been achieved. This point in the growth phase may be mimicked under continuous culture conditions supporting a generation time of at least 3 days. In a preferred embodiment, the stationary phase mycobacterial cells are harvested when the viable counts per ml of culture medium has fallen by at least 0.5, preferably at least 1, more preferably at least 2 log units less than the maximum number of viable counts per ml of culture medium. Thus, the nutrient-starved cells are generally harvested during mid- to late-stationary phase.

For example, if the maximum viable count value is $1\times10^{10}$ per ml, then the stationary phase cells would be preferably harvested once the viable count number had fallen to a value of at least $1\times10^{9.5}$, preferably at least $1\times10^{9}$, more preferably at least $1\times10^{8}$ viable counts per ml. In the case of *M. tuberculosis*, this would be approximately at least day 20, preferably at least day 30, typically day 40-50 post-inoculation. Longer post-inoculation harvesting times of at least 100 days, even at least 150 days may be employed. For *mycobacteria* generally, the mid to late stationary phase cells are preferably harvested at least 20 days, preferably at least 30 days, more preferably at least 40 days post-inoculation.

Suitable media for culturing *mycobacteria* are described in Wayne, L. G. (1994) [in Tuberculosis: Pathogenesis, Protection, and Control published by the American Society for Microbiology, pp. 73-83]. These include Middlebrook 7H9 Medium [see Barker, L. P., et al. (1998) Molec. Microbiol., vol. 29(5), pp. 1167-1177], and WO00/52139 in the name of the present Applicant.

In use of the batch fermenter culture method, the starting concentration of the primary carbon source (and preferably the primary energy source) is at least 0.5, preferably at least 1 $gl^{-1}$ of culture medium. Such concentrations are considered to be not nutrient-starving. Conversely, “nutrient-starving” conditions are associated with a primary carbon and energy source concentration of less than 0.5, preferably less than 0.2, and more preferably less than 0.1 $gl^{-1}$ of culture medium. The preferred carbon and energy source is glycerol.

In a preferred embodiment, the starting concentration of glycerol is at least 1, preferably 1-3, more preferably approximately 2 $gl^{-1}$ of culture medium. The onset of “nutrient-starving” conditions is associated with a concentration of less than 0.2, preferably less than 0.1 $gl^{-1}$ of culture medium.

Other primary carbon and energy sources may be employed such as glucose, pyruvate, and fatty acids (eg. palmitate, and butyrate). These sources may be employed at substantially the same concentrations as for glycerol.

The pH of the culture medium is preferably maintained between pH 6 and 8, more preferably between pH 6.5 and 7.5, most preferably at about pH 6.9.

In one embodiment, the dissolved oxygen tension (DOT) is maintained throughout the culture process at at least 40% air saturation, more preferably between 50 and 70% air saturation, most preferably at 50% air saturation.

The dissolved oxygen tension parameter is calculated by means of an oxygen electrode and conventional laboratory techniques. Thus, 100% air saturation corresponds to a solution that is saturated with air, whereas 0% corresponds to a solution that has been thoroughly purged with an inert gas such as nitrogen. Calibration is performed under standard atmospheric pressure conditions and measured at 37° C., and with conventional air comprising approximately 21% oxygen.

In another embodiment of the present invention, latency may be induced by a combination of carbon and/or energy source starvation, and a low DOT.

In a preferred embodiment, the DOT is maintained at at least 40% air saturation, more preferably between 50 and 70% air saturation, until the mycobacterial culture has entered early-mid log phase. The DOT may be then lowered so as to become limiting, for example in increments over a 5 or 6 day period, and the culture maintained at a DOT of 0-10, preferably at a DOT of approximately 5% until the stationary phase cells are harvested.

The carbon and energy starvation, and optional low oxygen tension latency induction conditions of the present invention are culture conditions-that are conducive for a *mycobacterium* to express at least one gene which would be normally expressed in vivo during latency of the mycobacterium’s natural target environment which is believed to involve a low carbon and energy, and low oxygen environment.

The *mycobacterium* is selected from the species *M. phlei, M. smegmatis, M. africanum, M. caneti, M. fortuitum, M. marinum, M. ulcerans, M. tuberculosis, M. bovis, M. microti, M. avium, M. paratuberculosis, M. leprae, M. lepraemurium, M. intracellulare, M. scrofulaceum, M. xenopi, M. genavense, M. kansasii, M. simiae, M. szulgai, M. haemophilum, M. asiaticum, M. malmoense, M. vaccae* and *M. shimoidei*. Of particular interest are members of the MTC, preferably *M. tuberculosis.*

In use, it is preferred that those genes (ie. as represented by cDNAs in the detection assay) which are up-regulated by at least 1.5-fold under stationary phase conditions vis-a-vis exponential phase conditions are selected. In more preferred embodiments, the corresponding up-regulation selection criterium is at least 2-fold, more preferably 3-fold, most preferably 4-fold. In further embodiments up-regulation levels of at least 10-fold, preferably 50-fold may be employed.

The term peptide throughout this specification is synonymous with protein.

Use of mycobacterial peptide compositions, which peptides are associated with mycobacterial latency, provide excellent vaccine candidates for targeting latent mycobacteria in asymptomatic patients infected with *mycobacteria*.

The terms "isolated," "substantially pure," and "substantially homogenous" are used interchangeably to describe a peptide which has been separated from components which naturally accompany it. A peptide is substantially pure when at least about 60 to 75% of a sample exhibits a single peptide sequence. A substantially pure peptide will typically comprise about 60 to 90% w/w of a protein sample, more usually about 95%, and preferably will be over about 99% pure. Peptide purity or homogeneity may be indicated by, for example, polyacrylamide gel electrophoresis of a protein sample, followed by visualizing a single polypeptide band upon staining the gel. Alternatively, higher resolution may be provided by using, for example, HPLC.

A peptide is considered to be isolated when it is separated from the contaminants which accompany it in its natural state. Thus, a peptide which is chemically synthesized or synthesized in a cellular system different from the cell from which it naturally originates will be substantially free from its naturally associated components.

The present invention provides peptides which may be purified from mycobacteria as well as from other types of cells transformed with recombinant nucleic acids encoding these peptides.

If desirable, the amino acid sequence of the proteins of the present invention may be determined by protein sequencing methods.

The terms "peptide", "oligopeptide", "polypeptide", and "protein" are used interchangeably and do not refer to a specific length of the product. These terms embrace post-translational modifications such as glycosylation, acetylation, and phosphorylation.

The term "fragment" means a peptide having at least five, preferably at least ten, more preferably at least twenty, and most preferably at least thirty-five amino acid residues of the peptide which is the gene product of the induced or up-regulated gene in question. The fragment preferably includes an epitope of the gene product in question.

The term "variant" means a peptide or peptide "fragment" having at least seventy, preferably at least eighty, more preferably at least ninety percent amino acid sequence homology with the peptide that is the gene product of the induced or up-regulated gene in question. An example of a "variant" is a peptide or peptide fragment of an induced/up-regulated gene which contains one or more analogues of an amino acid (eg. an unnatural amino acid), or a substituted linkage. The terms "homology" and "identity" are considered synonymous in this specification. In a further embodiment, a "variant" may be a mimic of the peptide or peptide fragment, which mimic reproduces at least one, epitope of the peptide or peptide fragment. The mimic may be, for example, a nucleic acid mimic, preferably a DNA mimic.

For sequence comparison, typically one sequence acts as a reference sequence, to which test sequences may be compared. When using a sequence comparison algorithm, test and reference sequences are input into a computer, subsequent coordinates are designated, if necessary, and sequence algorithm program parameters are designated. The sequence comparison algorithm then calculates the percentage sequence identity for the test sequence(s) relative to the reference sequence, based on the designated program parameters.

Optimal alignment of sequences for comparison may be conducted, for example, by the local homology alignment algorithm of Smith and Waterman [Adv. Appl. Math. 2: 484 (1981)], by the algorithm of Needleman & Wunsch [J. Mol. Biol. 48: 443 (1970)] by the search for similarity method of Pearson & Lipman (Proc. Nat'l. Acad. Sci. USA 85: 2444 (1988)], by computer implementations of these algorithms (GAP, BESTFIT, FASTA, and TFASTA-Sequence Analysis Software Package of the Genetics Computer Group, University of Wisconsin Biotechnology Center, 1710 University. Avenue, Madison, Wis., 53705), or by visual inspection [see Current Protocols in Molecular Biology, F. M. Ausbel et al, eds, Current Protocols, a joint venture between Greene Publishing Associates, Inc. and John Wiley & Sons, Inc. (1995 Supplement) Ausbubel].

Examples of algorithms suitable for determining percent sequence similarity are the BLAST and the BLAST 2.0 algorithms [see Altschul (1990) J. Mol. Biol. 215: pp. 403-410].

In a preferred homology comparison, the identity exists over a region of the sequences that is at least 10 amino acid residues in length.

The term "derivative" means a peptide comprising the peptide (or fragment, or variant thereof) which is the gene product of the induced or up-regulated gene in question. Thus, a derivative may include the peptide in question, and a further peptide sequence which may introduce one or more additional epitopes.

The further peptide sequence should preferably not interfere with the basic folding and thus conformational structure of the peptide in question. Examples of a "derivative" are a fusion protein, a conjugate, and a graft. Thus, two or more peptides (or fragments, or variants) may be joined together to form a derivative. Alternatively, a peptide (or fragment, or variant) may be joined to an unrelated molecule (eg. a peptide). Derivatives may be chemically synthesized, but will be typically prepared by recombinant nucleic acid methods. Additional components such as lipid, and/or polysaccharide, and/or polyketide components may be included.

All of the molecules "fragment", "variant" and "derivative" have a common antigenic cross-reactivity and/or substantially the same in vivo biological activity as the gene product of the induced or up-regulated gene in question from which they are derived. For example, an antibody capable of binding to a fragment, variant or derivative would be also capable of binding to the gene product of the induced or up-regulated gene in question. It is a preferred feature that the fragment, variant and derivative each possess the active site of the peptide which is the induced or up-regulated peptide in question. Alternatively, all of the above embodiments of a peptide of the present invention share a common ability to induce a "recall response" of a T-lymphocyte which has been previously exposed to an antigenic component of a mycobacterial infection.

In a preferred embodiment, the peptide is selected from the group consisting of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279 and 281.

According to a second aspect of the invention there is provided a method of identifying a mycobacterial gene the expression of which is induced or up-regulated during mycobacterial latency, said method comprising:—

- culturing a first *micobacterium* under culture conditions that are nutrient-starving and which maintain mycobacterial latency, said conditions being obtainable by batch fermentation of the first *micobacterium* for at least 20 days post-inoculation;
- culturing a second *micobacterium* under culture conditions that are not nutrient-starving and which support exponential growth of the second *mycobacterium;*
- obtaining first and second mRNA populations from said first and second mycobacteria respectively, wherein said first mRNA population is obtained from the first *micobacterium* which has been cultured under nutrient-starving conditions obtainable by batch fermentation of the first *micobacterium* for at least 20 days post-inoculation, and wherein said second mRNA is obtained from the second *micobacterium* which has been cultured under conditions that are not nutrient-starving and which support exponential growth of said second, *mycobacterium;*
- preparing first and second cDNA populations from said first- and second mRNA populations respectively, during which cDNA preparation a detectable label is introduced into the cDNA molecules of the first and second cDNA populations;
- isolating corresponding first and second cDNA molecules from the first and second cDNA populations, respectively;
- comparing relative amounts of label or corresponding signal emitted from the label present in the isolated first and second cDNA molecules;
- identifying a greater amount of label or signal provided by the isolated first cDNA molecule than that provided by the isolated second cDNA molecule; and
- identifying the first cDNA and the corresponding mycobacterial gene which is induced or up-regulated during mycobacterial latency.

Reference to gene throughout this specification embraces open reading frames (ORFs).

The various embodiments described for the first aspect of the present invention apply equally to the second and subsequent aspects of the present invention.

The term "corresponding first and second cDNA molecules from the first and second cDNA populations" refers to cDNAs having substantially the same nucleotide sequence. Thus, by isolating the cDNA copies relating to a given gene under each culture condition (ie. exponential phase, and stationary phase), it is possible to quantify the relative copy number of cDNA for that gene for each culture condition. Since each cDNA copy has been produced from an mRNA molecule, the cDNA copy number reflects the corresponding mRNA copy number for each culture condition, and thus it is possible to identify induced or up-regulated genes.

In one embodiment, the first and second cDNA molecules are isolated from the corresponding first and second cDNA populations by hybridization to an array containing immobilized DNA sequences that are representative of each known gene (or ORF) within a particular mycobacterial species genome. Thus, a first cDNA may be considered "corresponding" to a second cDNA if both cDNAs hybridize to the same immobilized DNA sequence.

In another embodiment, the first and second cDNAs are prepared by incorporation of a fluorescent label. The first and second cDNAs may incorporate labels which fluoresce at different wavelengths, thereby permitting dual fluorescence and simultaneous detection of two cDNA samples.

The type of label employed naturally determines how the output of the detection method is read. When using fluorescent labels, a confocal laser scanner is preferably employed.

According to one embodiment, fluorescently labelled cDNA sequences from stationary and exponential phase cultured systems were allowed to hybridize with a whole mycobacterial genome array. The first cDNA population was labelled with fluorescent label A, and the second cDNA population was labelled with fluorescent label B. The array was scanned at two different wavelengths corresponding to the excitable maxima of each dye and the intensity of the emitted light was recorded. Multiple arrays were preferably prepared for each cDNA and a mean intensity value was calculated across the two cDNA populations for each spot with each dye, against which relative induction or upregulation was quantified.

In addition to the above mRNA isolation and cDNA preparation and labelling, genomic DNA may be isolated from the first and second *mycobacteria*. Thus, in a preferred embodiment, labelled DNA is also prepared from the isolated DNA. The labelled DNA may be then included on each array as a control.

According to a third aspect of the present invention, there is provided an inhibitor of a mycobacterial peptide, wherein the peptide is encoded by a gene the expression of Which is induced or up-regulated under culture conditions that are nutrient-starving and which maintain mycobacterial latency, said conditions being obtainable by batch fermentation of a *micobacterium* for at least 20 days post-inoculation, when compared with culture conditions that are not nutrient-starving and which support exponential growth of said *mycobacterium*, wherein the inhibitor is capable of preventing or inhibiting the mycobacterial peptide, from exerting its native biological effect.

Such inhibitors may be employed to prevent the onset of, or to cause a break in the period of mycobacterial latency (ie. induce re-activation). In this respect, mycobacteria are more susceptible to treatment regimens when in a non-latent state, and the combined use of drugs to kill latent *mycobacteria* (eg. TB) would significantly reduce the incidence of *mycobacteria* by targeting the reservoir for new disease and would thereby help reduce the problem of emerging drug-resistant strains.

The inhibitor may be a peptide, carbohydrate, synthetic molecule, or an analogue thereof. Inhibition of the mycobacterial peptide may be effected at the nucleic acid level (ie. DNA, or RNA), or at the peptide level. Thus, the inhibitor may act directly on the peptide. Alternatively, the inhibitor may act indirectly on the peptide by, for example, causing inactivation of the induced or up-regulated mycobacterial gene.

In preferred embodiments, the inhibitor is capable of inhibiting one or more of the following:—2-nitropropane dioxygenase, acetyltransferase, oxidoreductase, transcriptional regulator, acyl transferase, UDP-glucose dehydrogenase, phosphoribosylglycinamide formyltransferase, 1,4-dihydroxy-2-naphthoate octaprenyl, gmc-type oxidoreductase, 3-hydroxyisobutyrate dehydrogenase, methylmalonate semialdehyde dehydrogenase, dehydrogenase, mercuric reductase, glutathione reductase, dihydrolipoamide, transposase, proline iminopeptidase, protyl aminopeptidase, quinolone efflux pump, glycine betaine transporter, phosphatidylethanolamine N-methyltransferase, chalcone synthase 2, sulfotransferase, glycosyl transferase, fumarate reductase-flavoprotein, 8-amino-7-oxononanoate synthase, aminotransferase class-II pyridoxal-phosphate, bacteriophage HK97 prohead protease, penicillin-binding protein, fatty acyl-CoA racemase, nitrilotriacetate monooxygenase, histidine kinase response regulator, peptidase, LysR transcription regulator, excisionase, ornithine aminotransferase, malate oxidoreductase, thiosulphate binding protein, enoyl-CoA hydratase, acyl-CoA synthetase, methyltransferase, siroheme synthase, permease, glutaryl 7-aca acylase, sn-glycerol-3-phosphate transport system permease, enoyl-CoA hydratase/isomerase, acyl-CoA dehydrogenase, esterase, lipase, cytidine deaminase, crotonase, lipid-transfer protein, acetyl-CoA C-acetyltransferase, aminotransferase, hydrolase, and 2-amino-4-hydroxy-6-hydroxymethyldihydropterine pyrophosphokinase.

In a further embodiment, the inhibitor may be an antibiotic capable of targeting the induced or up-regulated mycobacterial gene identifiable by, the present invention, or the gene product thereof. The antibiotic is preferably specific for the gene and/or gene product.

In a further embodiment, the inhibitor may act on a gene or gene product the latter of which interacts with the induced or up-regulated gene. Alternatively, the inhibitor may act on a gene or gene product thereof upon which the gene product of the induced or up-regulated gene acts.

Inhibitors of the present invention may be prepared utilizing the sequence information of provided herein. For example, this may be performed by overexpressing the peptide, purifying the peptide, and then performing X-ray crystallography on the purified peptide to obtain its molecular structure. Next, compounds are created which have similar molecular structures to all or portions of the polypeptide or its substrate. The compounds may be then combined with the peptide and attached thereto so as to block one or more of its biological activities.

Also included within the invention are isolated or recombinant polynucleotides that bind to the regions of the mycobacterial chromosome containing sequences that are associated with induction/up-regulation under low oxygen tension (ie. virulence), including antisense and triplex-forming polynucleotides. As used herein, the term “binding” refers to an interaction or complexation between an oligonucleotide and a target nucleotide sequence, mediated through hydrogen bonding or other molecular forces. The term “binding” more specifically refers to two types of internucleotide binding mediated through base-base hydrogen bonding. The first type of binding is “Watson-Crick-type” binding interactions in which adenine-thymine (or adenine-uracil) and guanine-cytosine base-pairs are formed through hydrogen bonding between the bases. An example of this type of binding is the binding traditionally associated with the DNA double helix and in RNA-DNA hybrids; this type of binding is normally detected by hybridization procedures.

The second type of binding is “triplex binding”. In general, triplex binding refers to any type of base-base hydrogen bonding of a third polynucleotide strand with a duplex DNA (or DNA-RNA hybrid) that is already paired in a Watson-Crick manner.

In a preferred embodiment, the inhibitor may be an antisense nucleic acid sequence which is complementary to at least part of the inducible or up-regulatable gene.

The inhibitor, when in the form of a nucleic acid sequence, in use, comprises at least 15 nucleotides, preferably at least 20 nucleotides, more preferably at least 30 nucleotides, and most preferably at least 50 nucleotides.

According to a fourth aspect of the invention, there is provided an antibody that binds to a peptide encoded by a gene, or to a fragment or variant or derivative of said peptide, the expression of which gene is induced or up-regulated during culture of a *mycobacterium* under culture conditions that are nutrient-starving and which maintain mycobacterial latency, said conditions being obtainable by batch fermentation of a *mycobacterium* for at least 20 days post-inoculation, when compared with culture conditions that are not-nutrient-starving and which support exponential growth of said *mycobacterium.*

The antibody preferably has specificity for the peptide in question, and following binding thereto may initiate coating of the *mycobacterium*. Coating of the bacterium preferably leads to opsonization thereof. This, in turn, leads to the bacterium being destroyed. It is preferred that the antibody is specific for the *mycobacterium* (eg. species and/or strain) which is to be targeted.

In use, the antibody is preferably embodied in an isolated form.

Opsonization by antibodies may influence cellular entry and spread of mycobacteria in phagocytic and non-phagocytic cells by preventing or modulating receptor-mediated entry and replication in macrophages.

The peptides, fragments, variants or derivatives of the present invention may be used to produce antibodies, including polyclonal and monoclonal antibodies. If polyclonal antibodies are desired, a selected mammal (eg. mouse, rabbit, goat, horse, etc.) is immunized with an immunogenic polypeptide. Serum from the immunized animal is collected and treated according to known procedures. If serum containing polyclonal antibodies to a desired mycobacterial epitope contains antibodies to other antigens, the polyclonal antibodies may be purified by immunoaffinity chromatography.

Alternatively, general methodology for making monoclonal antibodies by hybridomas involving, for example, preparation of immortal antibody-producing cell lines by cell fusion, or other techniques such as direct transformation of B lymphocytes with oncogenic DNA, or transfection with Epstein-Barr virus may be employed.

The antibody employed in this aspect of the invention may belong to any antibody isotype family, or may be a derivative or mimic thereof. Reference to antibody throughout this specification embraces recombinantly produced antibody, and any part of an antibody which is capable of binding to a mycobacterial antigen.

In one embodiment the antibody belongs to the IgG, IgM or IgA isotype families.

In a preferred embodiment, the antibody belongs to the IgA isotype family. Reference to the IgA isotype throughout this specification includes the secretory form of this antibody (ie. sIgA). The secretory component (SC) of sIgA may be added in vitro or in vivo. In the latter case, the use of a patient’s natural SC labelling machinery may be employed.

In one embodiment, the antibody may be raised against a peptide from a member of the MTC, preferably against *M. tuberculosis.*

In a preferred embodiment, the antibody is capable of binding to a peptide selected from the group consisting of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281 and a fragment, variant, and derivative of said SEQ IDs.

In a further embodiment, the antigen is an exposed component of a mycobacterial *bacillus*. In another embodiment, the antigen is, a cell surface component of a mycobacterial *bacillus*.

The antibody of the present invention may be polyclonal, but is preferably monoclonal.

Without being bound by any theory, it is possible that following mycobacterial infection of a macrophage, the macrophage is killed and the *bacilli* are released. It is at this stage that the *mycobacteria* are considered to be most vulnerable to antibody attack. Thus, it is possible that the antibodies of the present invention act on released *bacilli* following macrophage death, and thereby exert a post-infection effect.

It is possible that the passive protection aspect (ie. delivery of antibodies) of the present invention is facilitated by enhanced accessibility of the antibodies of the present invention to antigens on mycobacterial *bacilli* harboured by the infected macrophages. Indeed, acr expression is low during logarithmic growth, but increases at the stationary or oxygen limiting stage, and particularly in organisms which replicate within macrophages. As acr expression appears to be necessary for mycobacterial infectivity, it is possible that antibody binding may block macrophage infection by steric hindrance or disruption of its oligomeric structure. Thus, antibodies acting on mycobacterial *bacilli* released from killed, infected macrophages may interfere with the spread of re-infection to fresh macrophages. This hypothesis involves a synergistic action between antibodies and cytotoxic T cells, acting early after infection, eg. γδ and NK T cells, but could later involve also CD8 and CD4 cytotoxic T cells.

According to a fifth aspect of the invention, there is provided an attenuated *micobacterium* in which a gene has been modified thereby rendering the *micobacterium* substantially non-pathogenic, wherein said gene is a gene the expression of which is induced or up-regulated during culture conditions that are nutrient-starving and which maintain mycobacterial latency, said conditions being obtainable by batch fermentation of a *micobacterium* for at least 20 days post-inoculation, when compared with culture conditions that are not nutrient-starving and which support exponential growth of said *mycobacterium*.

The modification preferably inactivates the gene in question, and preferably renders the *micobacterium* substantially non-pathogenic.

The term "modified" refers to any genetic manipulation such as a nucleic acid or nucleic acid sequence replacement, a deletion, or an insertion which renders the *micobacterium* substantially reduced in ability to persist in a latent state. In one embodiment the entire inducible or up-regulatable gene may be deleted.

In a preferred embodiment, gene to be modified has a wild-type coding sequence selected from the group consisting of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250 252, 254, 256, 258, 260, 262, 264, 266, 268, 270, 272, 274, 276, 278, 280 and 282.

It will be appreciated that the above wild-type sequences may include minor variations depending on the Database employed. The term "wild-type" indicates that the sequence in question exists as a coding sequence in nature.

According to a sixth aspect of the invention, there is provided an attenuated microbial carrier, comprising a peptide encoded by a gene, or a fragment or variant or derivative of said peptide, the expression of which gene is induced or up-regulated under culture conditions that are nutrient-starving and which maintain mycobacterial latency, said conditions being obtainable by batch fermentation of a *micobacterium* for at least 20 days post-inoculation, when compared with culture conditions that are not nutrient-starving and which support exponential growth of said *mycobacterium*.

In use, the peptide (or fragment, variant or derivative) is either at least partially exposed at the surface of the carrier, or the carrier becomes degraded in vivo so that at least part of the peptide (or fragment, variant or derivative) is otherwise exposed to a host's immune system.

In a preferred embodiment, the attenuated microbial carrier is attenuated *salmonella*, attenuated *vaccinia* virus, attenuated fowlpox virus, or attenuated *M. bovis* (eg. BCG strain).

In a preferred embodiment, the peptide is selected from the group consisting of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279 and 281.

According to a seventh aspect of the invention, there is provided a DNA plasmid comprising a promoter, a polyadenylation signal, and a DNA sequence that is the coding sequence of a mycobacterial gene or a fragment or variant of derivative of said coding sequence, the expression of which gene is induced or up-regulated under culture conditions that are nutrient-starving and which maintain mycobacterial latency, said conditions being obtainable by batch fermentation of a, *micobacterium* for at least 20 days post-inoculation, when compared with culture conditions that are not nutrient-starving and which support exponential growth of said *mycobacterium*, wherein the promoter and polyadenylation signal are operably linked to the DNA sequence.

The term DNA "fragment" used in this invention will usually comprise at least about 5 codons (15 nucleotides), more usually at least about 7 to 15 codons, and most preferably at least about 35 codons. This number of nucleotides is usually about the minimal length required for a successful probe that would hybridize specifically with such a sequence.

In preferred embodiments, the DNA "fragment" has a nucleotide length which is at least 50%, preferably at least 70%, and more preferably at least 80% that of the coding sequence of the corresponding induced/up-regulated gene.

The term DNA "variant" means a DNA sequence that has substantial homology or substantial similarity to the coding sequence (or a fragment thereof) of an induced/up-regulated gene. A nucleic acid or fragment thereof is "substantially homologous" (or "substantially similar") to another if, when optimally aligned (with appropriate nucleotide insertions or deletions) with the other nucleic acid (or its complementary strand), there is nucleotide sequence identity in at least about 60% of the nucleotide bases, usually at least about 70%, more usually at least about 80%, preferably at least about 90%, and more preferably at least about 95 to 98% of the nucleotide bases. Homology determination is performed as described supra for peptides.

Alternatively, a DNA "variant" is substantially homologous (or substantially similar) with the coding sequence (or a fragment thereof) of an induced/up-regulated gene when they are capable of hybridizing under selective hybridization conditions. Selectivity of hybridization exists when hybridization occurs which is substantially more selective than total lack of specificity. Typically, selective hybridization will occur when there is at least about 65% homology over a stretch of at least about 14 nucleotides, preferably at least about 70%, more preferably at least about 75%, and most preferably at least about 90%. See, Kanehisa (1984) Nuc. Acids Res. 12:203-213. The length of homology comparison, as described, may be over longer stretches, and in certain embodiments will often be over a stretch of at least about 17 nucleotides, usually at least about 20 nucleotides, more usually at least about 24 nucleotides, typically at least about 28 nucleotides, more typically at least about 32 nucleotides, and preferably at least about 36 or more nucleotides.

Nucleic acid hybridization will be affected by such conditions as salt concentration (eg. NaCl), temperature, or organic solvents, in addition to the base composition, length of the complementary strands, and the number of nucleotide base mismatches between the hybridizing nucleic acids, as will be readily appreciated by those skilled in the art. Stringent temperature conditions are preferably employed, and generally include temperatures in excess of 30° C., typically in excess of 37° C. and preferably in excess of 45° C. Stringent salt conditions will ordinarily be less than 1000 mM, typically less than 500 mM, and preferably less than 200 mM. The pH is typically between 7.0 and 8.3. However, the combination of parameters is much more important than the measure of any single parameter. See, eg., Wetmur and Davidson (1968) J. Mol. Biol. 31:349-370.

The term DNA "derivative" means a DNA polynucleotide which comprises a DNA sequence. (or a fragment, or variant thereof) corresponding to the coding sequence of the induced/up-regulated gene and an additional DNA sequence which is not naturally associated with the DNA sequence corresponding to the coding sequence. The comments on peptide derivative supra also apply to DNA "derivative". A "derivative" may, for example, include two or more coding sequences of a mycobacterial operon that is induced during nutrient-starvation. Thus, depending on the presence or absence of a non-coding region between the coding sequences, the expression product/s of such a "derivative" may be a fusion protein, or separate peptide products encoded by the individual coding regions.

The above terms DNA "fragment", "variant", and "derivative" have in common with each other that the resulting peptide products have cross-reactive antigenic properties which are substantially the same as those of the corresponding wild-type peptide. Preferably all of the peptide products of the above DNA molecule embodiments of the present invention bind to an antibody which also binds to the wild-type peptide. Alternatively, all of the above peptide products are capable of inducing a "recall responses" of a T lymphocyte which has been previously exposed to an antigenic component of a mycobacterial infection.

The promoter and polyadenylation signal are preferably selected so as to ensure that the, gene is expressed in a eukaryotic cell. Strong promoters and polyadenylation signals are preferred.

In a related aspect, the present invention provides an isolated RNA molecule which is encoded by a DNA sequence of the present invention, or a fragment or variant or derivative of said DNA sequence.

An "isolated" RNA is an RNA which is substantially separated from other mycobacterial components that naturally accompany the sequences of interest, eg., ribosomes, polymerases, and other mycobacterial polynucleotides such as DNA and other chromosomal sequences.

The above RNA molecule may be introduced directly into a host cell as, for example, a component of a vaccine.

Alternatively the RNA molecule may be incorporated into an RNA vector prior to administration.

The polynucleotide sequences (DNA and RNA) of the present invention include a nucleic acid sequence which has been removed from its naturally occurring environment, and recombinant or cloned DNA isolates and chemically synthesized analogues or analogues biologically synthesized by heterologous systems.

The term "recombinant" as used herein intends a polynucleotide of genomic, cDNA, semisynthetic, or synthetic origin which, by virtue of its origin or manipulation: (1) is not associated with all or a portion of a polynucleotide with which it is associated in nature; or (2) is linked to a polynucleotide other than that to which it is linked in nature; and (3) does not occur in nature. This artificial combination is often accomplished by either chemical synthesis means, or by the artificial manipulation of isolated segments of nucleic acids, eg., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions.

In embodiments of the invention the polynucleotides may encode a peptide (or fragment, variant, or derivative) which is induced or up-regulated under nutrient-starving conditions. A nucleic acid is said to "encode" a peptide if, in its native state or when manipulated, it can be transcribed and/or translated to produce the peptide (or fragment, variant or derivative thereof). The anti-sense strand of such a nucleic acid is also said to encode the peptide (or fragment, variant, or derivative).

Also contemplated within the invention are expression vectors comprising the polynucleotide of interest. Expression vectors "generally" are replicable polynucleotide constructs that encode a peptide operably linked to suitable transcriptional and translational regulatory elements. Examples of regulatory elements usually included in expression vectors are promoters enhancers, ribosomal binding sites, and transcription and translation initiation and termination sequences. These regulatory elements are operably linked to the sequence to be translated. A nucleic acid sequence is operably linked when it is placed into a functional relationship with another nucleic acid sequence. For instance, a promoter is operably linked to a coding sequence if the promoter affects its transcription or expression. Generally, operably linked means that the DNA sequences being linked are contiguous and, where necessary to join two protein coding regions, contiguous and in reading frame. The regulatory elements employed in the expression vectors containing a polynucleotide encoding a virulence factor are functional in the host cell used for expression.

The polynucleotides of the present invention may be prepared by any means known in the art. For example, large amounts of the polynucleotides may be produced by replication in a suitable host cell. The natural or synthetic DNA fragments coding for a desired fragment will be incorporated into recombinant nucleic acid constructs, typically DNA constructs, capable of introduction into and replication in a prokaryotic or eukaryotic cell. Usually the DNA constructs will be suitable for autonomous replication in a unicellular host, such as yeast or bacteria, but may also be intended for introduction to and integration within the genome of a cultured insect, mammalian, plant or other eukaryotic cell lines.

The polynucleotides of the present invention may also be produced by chemical synthesis, e.g., by the phosphoramidite method or the triester method, and may be performed on commercial automated oligonucleotide synthesizers. A double-stranded fragment may be obtained from the single stranded product of chemical synthesis either by synthesizing the complementary strand and annealing the strand together under appropriate conditions or by adding the complementary strand using DNA polymerase with an appropriate primer sequence.

DNA constructs prepared for introduction into a prokaryotic or eukaryotic host will typically comprise a replication system recognized by the host, including the intended DNA fragment encoding the desired peptide, and will preferably also include transcription and translational initiation regulatory sequences operably linked to the polypeptide encoding segment. Expression vectors may include, for example, an origin of replication or autonomously replicating sequence (ARS) and expression control sequences, a promoter, an enhancer and necessary processing information sites, such as ribosome binding sites, RNA splice sites, polyadenylation sites, transcriptional terminator sequences, and mRNA stabilizing sequences. Secretion signals from polypeptides secreted from the host cell of choice may also be included where appropriate, thus allowing the protein to cross and/or lodge in cell membranes, and thus attain its functional topology or be secreted from the cell.

Appropriate promoter and other necessary vector sequences will be selected so as to be functional in the host, and may, when appropriate, include those naturally associated with mycobacterial genes. Promoters such as the trp, lac and phage promoters, tRNA promoters and glycolytic enzyme promoters may be used in prokaryotic hosts. Useful yeast promoters include the promoter regions for metallothionein, 3-phosphoglycerate kinase or other glycolytic enzymes such as enolase or glyceraldehyde-3-phosphate dehydrogenase, enzymes responsible for maltose and galactose utilization, and others.

Appropriate non-native mammalian promoters may include the early and late promoters from SV40 or promoters derived from murine moloney leukemia virus, mouse mammary tumour virus, avian sarcoma viruses, adenovirus II, bovine papilloma virus or polyoma. In addition, the construct may be joined to an amplifiable-gene (e.g., DHFR) so that multiple copies of the gene may be made While such expression vectors may replicate autonomously, they may less preferably replicate by being inserted into the genome of the host cell.

Expression and cloning vectors will likely contain a selectable marker, a gene encoding a protein necessary for the survival or growth of a host cell transformed with the vector. The presence of this gene ensures the growth of only those host cells which express the inserts. Typical selection genes encode proteins that (a) confer resistance to antibiotics or other toxic substances, e.g. ampicillin, neomycin, methotrexate, etc.; (b) complement auxotrophic deficiencies; or (c) supply critical nutrients not available from complex media, e.g. the gene encoding D-alanine racemase for *Bacilli*. The choice of appropriate selectable marker will depend on the host cell.

The vectors containing the nucleic acids of interest can be transcribed in vitro and the resulting RNA introduced into the host cell (e.g., by injection), or the vectors can be introduced directly into host cells by methods which vary depending on the type of cellular host, including electroporation; transfection employing calcium chloride, rubidium chloride, calcium phosphate, DEAE-dextran, or other substances; microprojectile bombardment; lipofection; infection (where the vector is an infectious agent, such as a retroviral genome). The cells into which have been introduced nucleic acids described above are meant to also include the progeny of such cells.

Large quantities of the nucleic acids and peptides of the present invention may be prepared by expressing the nucleic acids or portions thereof in vectors or other expression vehicles in compatible prokaryotic or eukaryotic host cells. The most commonly used prokaryotic hosts are strains of *Escherichia coli*, although other prokaryotes, such as *Bacillus subtilis* or *Pseudomonas* may also be used.

Mammalian or other eukaryotic host cells, such as those of yeast, filamentous fungi, plant, insect, amphibian or avian species, may also be useful for production of the proteins of the present invention. Propagation of mammalian cells in culture is per se well known. Examples of commonly used mammalian host cell lines are VERO and HeLa cells, Chinese hamster ovary (CHO) cells, and WI38, BHK, and COS cell lines, although other cell lines may be appropriate, e.g., to provide higher expression, desirable glycosylation patterns.

Clones are selected by using markers depending on the mode of the vector construction. The marker may be on the same or a different DNA molecule, preferably the same DNA molecule. The transformant may be screened or, preferably, selected by any of the means well known in the art, e.g., by resistance to such antibiotics as ampicillin, tetracycline.

The polynucleotides of the invention may be inserted into the host cell by any means known in the art, including for example, transformation, transduction, and electroporation. As used herein, "recombinant host cells", "host cells", "cells", "cell lines", "cell cultures", and other such terms denoting microorganisms or higher eukaryotic cell lines cultured as unicellular entities refer to cells which can be, or have been, used as recipients for recombinant vector or other transfer DNA, and include the progeny of the original cell which has been transformed. It is understood that the progeny of a single parental cell may not necessarily be completely identical in morphology or in genomic or total DNA complement as the original parent, due to natural, accidental, or deliberate mutation. "Transformation", as used herein, refers to the insertion of an exogenous polynucleotide into a host cell, irrespective of the method used for the insertion, for example, direct uptake, transduction, f-mating or electroporation. The exogenous polynucleotide may be maintained as a non-integrated vector, for example, a plasmid, or alternatively, may be integrated into the host cell genome.

In one embodiment, a DNA plasmid or RNA vector may encode a component of the immune system which is specific to an immune response following challenge with a peptide, wherein said peptide is encoded by a mycobacterial gene that is induced or up-regulated during nutrient-starvation, and optionally oxygen starvation.

An example of such a component is an antibody to the peptide product of the induced or up-regulated gene. Thus, in one embodiment, the nucleic acid sequence (eg. DNA plasmid, or RNA vector) encodes the antibody in question.

An eighth aspect provides use of the aforementioned aspects of the present invention, namely a peptide or fragment or variant or derivative thereof, an inhibitor, an antibody, an attenuated *mycobacterium*, an attenuated microbial carrier, a DNA sequence that is the coding sequence of an induced or up-regulated mycobacterial gene or a fragment or variant or derivative of said coding sequence, a DNA plasmid comprising said DNA sequence, an RNA sequence encoded by said DNA sequence (including DNA fragment, variant, derivative), and/or an RNA vector comprising said RNA, sequence, in the manufacture of a medicament for treating or preventing a mycobacterial infection.

The term “preventing” includes reducing the severity/intensity of, or initiation of, a mycobacterial infection.

The term “treating” includes post-infection therapy and amelioration of a mycobacterial infection.

In a related aspect, there is provided a method of treating or preventing a mycobacterial infection, comprising administration of a medicament (namely the aforementioned aspects of the present invention) selected from the group consisting of a peptide or fragment or variant or derivative thereof, an inhibitor, an antibody, an attenuated *mycobacterium*, an attenuated microbial carrier, a DNA sequence that is the coding sequence of an induced or up-regulated mycobacterial gene or a fragment or variant or derivative of said coding sequence, a DNA plasmid comprising said DNA sequence, an RNA sequence encoded by said DNA sequence, and/or an RNA vector comprising said RNA sequence, to a patient.

The immunogenicity of the epitopes of the peptides of the invention may be enhanced by preparing them in mammalian or yeast systems fused with or assembled with particle-forming proteins such as, for example, that associated with hepatitis B surface antigen. Vaccines may be prepared from one or more immunogenic peptides of the present invention.

Typically, such vaccines are prepared as injectables, either as liquid solutions or suspensions; solid forms suitable for solution in, or suspension in, liquid prior to injection may also be prepared. The preparation may also be emulsified, or the peptide encapsulated in liposomes. The active immunogenic ingredients are often mixed with excipients which are pharmaceutically acceptable and compatible with the active ingredient. Suitable excipients are, for example, water, saline, dextrose, glycerol, ethanol, or the like and combinations thereof. In addition, if desired, the vaccine may contain minor amounts of auxiliary substances such as wetting or emulsifying agents, pH buffering agents, and/or adjuvants which enhance the effectiveness of the vaccine. Examples of adjuvants which may be effective include but are not limited to: aluminum hydroxide, N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/Tween 80 emulsion.

The vaccines are conventionally administered parenterally, by injection, for example, either subcutaneously or intramuscularly. Additional formulations which are suitable for other modes of administration include suppositories and, in some cases, oral formulations or formulations suitable for distribution as aerosols. For suppositories, traditional binders and carriers may include, for example, polyalkylene glycols or triglycerides; such suppositories may be formed from mixtures containing the active ingredient in the range of 0.5% to 10%, preferably 1%-2%. Oral formulations include such normally employed excipients as, for example, pharmaceutical grades of mannitol, lactose, starch, magnesium stearate, sodium saccharine, cellulose, magnesium carbonate, and the like. These compositions take the form of solutions, suspensions, tablets, pills, capsules, sustained release formulations or powders and contain 10%-95% of active ingredient, preferably 25%-70%.

The peptides may be formulated into the vaccine as neutral or salt forms. Pharmaceutically acceptable salts include the acid addition salts (formed with free amino groups of the peptide) and which are formed with inorganic acids such as, for example, hydrochloric or phosphoric acids, or with organic acids such as acetic, oxalic, tartaric, maleic, and the like. Salts formed with the free carboxyl groups may also be derived from inorganic bases such as, for example, sodium, potassium, ammonium, calcium, or ferric hydroxides, and such organic bases as isopropylamine, trimethylamine, 2-ethylamino ethanol, histidine, procaine, and the like.

The vaccines are administered in a manner compatible with the dosage formulation, and in such amount as will be prophylactically and/or therapeutically effective. The quantity to be administered, which is generally in the range of 5 micrograms to 250 micrograms of antigen per dose, depends on the subject to be treated, capacity of the subject's immune, system to synthesize antibodies, and the degree of protection desired. Precise amounts of active ingredient required to be administered may depend on the judgment of the practitioner and may be peculiar to each subject.

The vaccine may be given in a single dose schedule, or preferably in a multiple dose schedule. A multiple dose schedule is one in which a primary course of vaccination may be with 1-10 separate doses, followed by other doses given at subsequent time intervals required to maintain and or re-enforce the immune response, for example, at 1-4 months for a second dose, and if needed, a subsequent dose(s) after several months. The dosage-regimen will also, at least in part, be determined by the need of the individual and be dependent upon the judgment of the practitioner.

In addition, the vaccine containing the immunogenic mycobacterial antigen(s) may be administered in conjunction with other immunoregulatory agents; for example, immunoglobulins, as well as antibiotics.

The medicament may be administered by conventional routes, eg. intravenous, intraperitoneal, intranasal routes.

The outcome of administering antibody-containing compositions may depend on the efficiency of transmission of antibodies to the site of infection. In the case of a mycobacterial respiratory infection (eg. a *M. tuberculosis* infection), this may be facilitated by efficient transmission of antibodies to the lungs.

In one embodiment the medicament may be administered intranasally (i.n.). This mode of delivery corresponds to the route of delivery of a *M. tuberculosis* infection and, in the case of antibody delivery, ensures that antibodies are present at the site of infection to combat the bacterium before it becomes intracellular and also during the period when it spreads between cells.

An intranasal composition may be administered in droplet form having approximate diameters in the range of 100-5000 μm, preferably 500-4000 μm; more preferably 1000-3000 μm. Alternatively, in terms of volume, the droplets would be in the approximate range of 0.001-100 μl, preferably 0.1-50 μl, more preferably 1.0-25 μl.

Intranasal administration may be achieved by way of applying nasal droplets or via a nasal spray.

In the case of nasal droplets, the droplets may typically have a diameter of approximately 1000-3000 μm and/or a volume of 1-25 μl.

In the case of a nasal spray, the droplets may typically have a diameter of approximately 100-1000 μm and/or a volume of 0.001-1 μl.

It is possible that, following i.n. delivery of antibodies, their passage to the lungs is facilitated by a reverse flow of mucosal secretions, although mucociliary action in the respiratory tract is thought to take particles within the mucus out of the lungs. The relatively long persistence in the lungs' lavage, fast clearance from the bile and lack of transport to the saliva of some antibodies suggest the role of mucosal site specific mechanisms.

In a different embodiment, the medicament may be delivered in an aerosol formulation. The aerosol formulation may take the form of a powder, suspension, or solution.

The size of aerosol particles is one factor relevant to the delivery capability of an aerosol. Thus, smaller particles may travel further down the respiratory airway towards the alveoli than would larger particles. In one embodiment, the aerosol particles have a diameter distribution to facilitate delivery along the entire length of the bronchi, bronchioles, and alveoli. Alternatively, the particle size distribution may be selected to target a particular section of the respiratory airway, for example the alveoli.

The aerosol particles may be delivered by way of a nebulizer or nasal spray.

In the case of aerosol delivery of the medicament, the particles may have diameters in the approximate range of 0.1-50 μm, preferably 1-25 μm, more preferably 1-5 μm.

The aerosol formulation of the medicament of the present invention may optionally contain a propellant and/or surfactant.

By controlling the size of the droplets which are to be administered to a patient to within the defined range of the present invention, it is possible to avoid/minimise inadvertent antigen delivery to the alveoli and thus avoid alveoli-associated pathological problems such as inflammation and fibrotic scarring of the lungs.

I.n. vaccination engages both T and B cell mediated effector mechanisms in nasal and bronchus associated mucosal tissues, which differ from other mucosae-associated lymphoid tissues.

The protective mechanisms invoked by the intranasal route of administration may include: the activation of T lymphocytes with preferential lung homing; upregulation of co-stimulatory molecules, eg. B7.2; and/or activation of macrophages or secretory IgA antibodies.

Intranasal delivery of antigens may facilitate a mucosal antibody response is involved which is favored by a shift in the T cell response toward the Th2 phenotype which helps antibody production. A mucosal response is characterized by enhanced IgA production, and a Th2 response is characterized by enhanced IL-4 production.

Intranasal delivery of mycobacterial antigens allows targeting of the antigens to submucosal B cells of the respiratory system. These B cells are the major local IgA-producing cells in mammals and intranasal delivery facilitates a rapid increase in IgA production by these cells against the mycobacterial antigens.

In one embodiment administration of the medicament comprising a mycobacterial antigen stimulates IgA antibody production, and the IgA antibody binds to the mycobacterial antigen. In another embodiment, a mucosal and/or Th2 immune response is stimulated.

In another embodiment monoclonal antibodies, in particular, may be used to raise anti-idiotype antibodies. Anti-idiotype antibodies are immunoglobulins which carry an "internal image" of the antigen of the infectious agent against which protection is desired. These anti-idiotype antibodies may also be useful for treatment, vaccination and/or diagnosis of mycobacterial infections.

According to a ninth aspect of the present invention, the peptides (including fragments, variants, and derivatives thereof) of the present invention and antibodies which bind thereto are useful in immunoassays to detect the presence of antibodies to *mycobacteria*, or the presence of the virulence associated antigens in biological samples. Design of the immunoassays is subject to a great deal of variation, and many formats are known in the art. The immunoassay may utilize at least one epitope derived from a peptide of the present invention. In one embodiment, the immunoassay uses a combination of such epitopes. These epitopes may be derived from the same or from different bacterial peptides, and may be in separate recombinant or natural peptides, or together in the same recombinant peptides.

An immunoassay may use, for example, a monoclonal antibody directed towards a virulence associated peptide epitope(s), a combination of monoclonal antibodies directed towards epitopes of one mycobacterial antigen, monoclonal antibodies directed towards epitopes of different mycobacterial antigens, polyclonal antibodies directed towards the same antigen, or polyclonal antibodies directed towards different antigens. Protocols may be based, for example, upon competition, or direct reaction, or sandwich type assays. Protocols may also, for example, use solid supports, or may be by immunoprecipitation. Most assays involve the use of labelled antibody for polypeptide; the labels may be, for example, enzymatic, fluorescent, chemiluminescent, radioactive, or dye molecules. Assays which amplify the signals from the probe are also known; examples of which are assays which utilize biotin and avidin, and enzyme-labelled and mediated immunoassays, such as ELISA assays.

Typically, an immunoassay for an antibody(s) to a peptide, will involve selecting and preparing the test sample suspected of containing the antibodies, such as a biological sample, then incubating it with an antigenic (i.e., epitope-containing) peptide(s) under conditions that allow antigen-antibody complexes to form, and then detecting the formation of such complexes. The immunoassay may be of a standard or competitive type.

The peptide is typically bound to a solid support to facilitate separation of the sample from the peptide after incubation. Examples of solid supports that can be used are nitrocellulose (e.g., in membrane or microtiter well form), polyvinyl chloride (e.g., in sheets or microtiter wells), polystyrene latex (e.g. in beads or microtiter plates, polyvinylidine fluoride (known as Immulon), diazotized paper, nylon membranes, activated beads, and Protein A beads. For example, Dynatech Immulon microtiter plates or 60 mm diameter polystyrene beads (Precision Plastic Ball) may be used. The solid support containing the antigenic peptide is typically washed after separating it from the test sample, and prior to detection of bound antibodies.

Complexes formed comprising antibody (or, in the case of competitive assays, the amount of competing antibody) are detected by any of a number of known techniques, depending on the format. For example, unlabelled antibodies in the complex may be detected using a conjugate of antixenogeneic Ig complexed with a label, (e.g., an enzyme label).

In immunoassays where the peptides are the analyte, the test sample, typically a biological sample, is incubated with antibodies directed against the peptide under conditions that allow the formation of antigen-antibody complexes. It may be desirable to treat the biological sample to release putative bacterial components prior to testing. Various formats can be employed. For example, a "sandwich assay" may be employed, where antibody bound to a solid support is incubated with the test sample; washed; incubated with a second, labelled antibody to the analyte, and the support is washed again. Analyte is detected by determining if the second antibody is bound to the support. In a competitive format, a test sample is usually incubated with antibody and a labelled, competing antigen is also incubated, either sequentially or simultaneously.

Also included as an embodiment of the invention is an immunoassay kit comprised of one or more peptides of the invention, or one or more antibodies to said peptides, and a buffer, packaged in suitable containers.

As used herein, a "biological sample" refers to a sample of tissue or fluid isolated from an individual, including but not limited to, for example, plasma, serum, spinal fluid, lymph fluid, the external sections of the skin, respiratory, intestinal and genitourinary tracts, tears, saliva, milk, blood cells, tumours, organs, and also samples of in vitro cell culture constituents (including but not limited to conditioned medium resulting from the growth of cells in cell culture medium, putatively virally infected cells, recombinant cells, and cell components).

In a related diagnostic assay, the present invention provides nucleic acid probes or detecting a mycobacterial infection.

Using the polynucleotides of the present invention as a basis, oligomers of approximately 8 nucleotides or more can be prepared, either by excision from recombinant polynucleotides or synthetically, which hybridize with the mycobacterial sequences, and are useful in identification of *mycobacteria*. The probes are a length which allows the detection of the induced or up-regulated sequences by hybridization. While 6-8 nucleotides may be a workable length, sequences of 10-12 nucleotides are preferred, and at least about 20 nucleotides appears optimal. These probes can be prepared using routine methods, including automated oligonucleotide synthetic methods. For use as probes, complete complementarity is desirable, though it may be unnecessary as the length of the fragment is increased.

For use of such probes as diagnostics, the biological sample to be analyzed, such as blood or serum, may be treated, if desired, to extract the nucleic acids contained therein. The resulting nucleic acid from the sample may be subjected to gel electrophoresis or other size separation techniques; alternatively, the nucleic acid sample may be dot blotted without size separation. The probes are usually labeled. Suitable labels, and methods for labeling probes are known in the art, and include, for example, radioactive labels incorporated by nick translation or kinasing, biotin, fluorescent probes, and chemiluminescent probes. The nucleic acids extracted from the sample are then treated with the labeled probe under hybridization conditions of suitable stringencies.

The probes may be made completely complementary to the virulence encoding polynucleotide. Therefore, usually high stringency conditions are desirable in order to prevent false positives. The stringency of hybridization is determined by a number of factors during hybridization and during the washing procedure, including temperature, ionic strength, length of time, and concentration of formamide.

It may be desirable to use amplification techniques in hybridization assays. Such techniques are known in the art and include, for example, the polymerase chain reaction (PCR) technique.

The probes may be packaged into diagnostic kits. Diagnostic kits include the probe DNA, which may be labelled; alternatively, the probe DNA may be unlabeled and the ingredients for labelling may be included in the kit in separate containers. The kit may also contain other suitably packaged reagents and materials needed for, the particular hybridization protocol, for example, standards, as well as instructions for conducting the test.

In a preferred embodiment, a peptide (or fragment or variant or derivative) of the present invention is used in a diagnostic assay to detect the presence of a T-lymphocyte which T lymphocyte has been previously exposed to an antigenic component of a mycobacterial infection in a patient.

In more detail, a T-lymphocyte which has been previously exposed to a particular antigen will be activated on subsequent challenge by the same antigen. This activation provides a means for identifying a positive diagnosis of mycobacterial infection. In contrast, the same activation is not achieved by a T-lymphocyte which has not been previously exposed to the particular antigen.

The above "activation" of a T-lymphocyte is sometimes referred to as a "recall response" and may be measured, for example, by determining the release of interferon (eg. IFN-Y) from the activated T-lymphocyte. Thus, the presence of a mycobacterial infection in a patient may be determined by the release of a minimum concentration of interferon from a T-lymphocyte after a defined time period following in vitro challenge of the T-lymphocyte with a peptide (or fragment or variant or derivative) of the present invention.

In use, a biological sample containing T-lymphocytes is taken from a patient, and then challenged with a peptide (or fragment, variant, Or derivative thereof) of the present invention.

The above T-lymphocyte diagnostic assay may include an antigen presenting cell (APC) expressing at least one major histocompatibility complex (MHC) class II molecule expressed by the patient in question. The APC may be inherently provided in the biological sample, or may be added exogenously. In one embodiment, the T-lymphocyte is a CD4 T-lymphocyte.

Brief mention is now made to the Figures of the present application, in which:—

EXAMPLE 1

Culture of *Mycobacteria*

Figure 1:
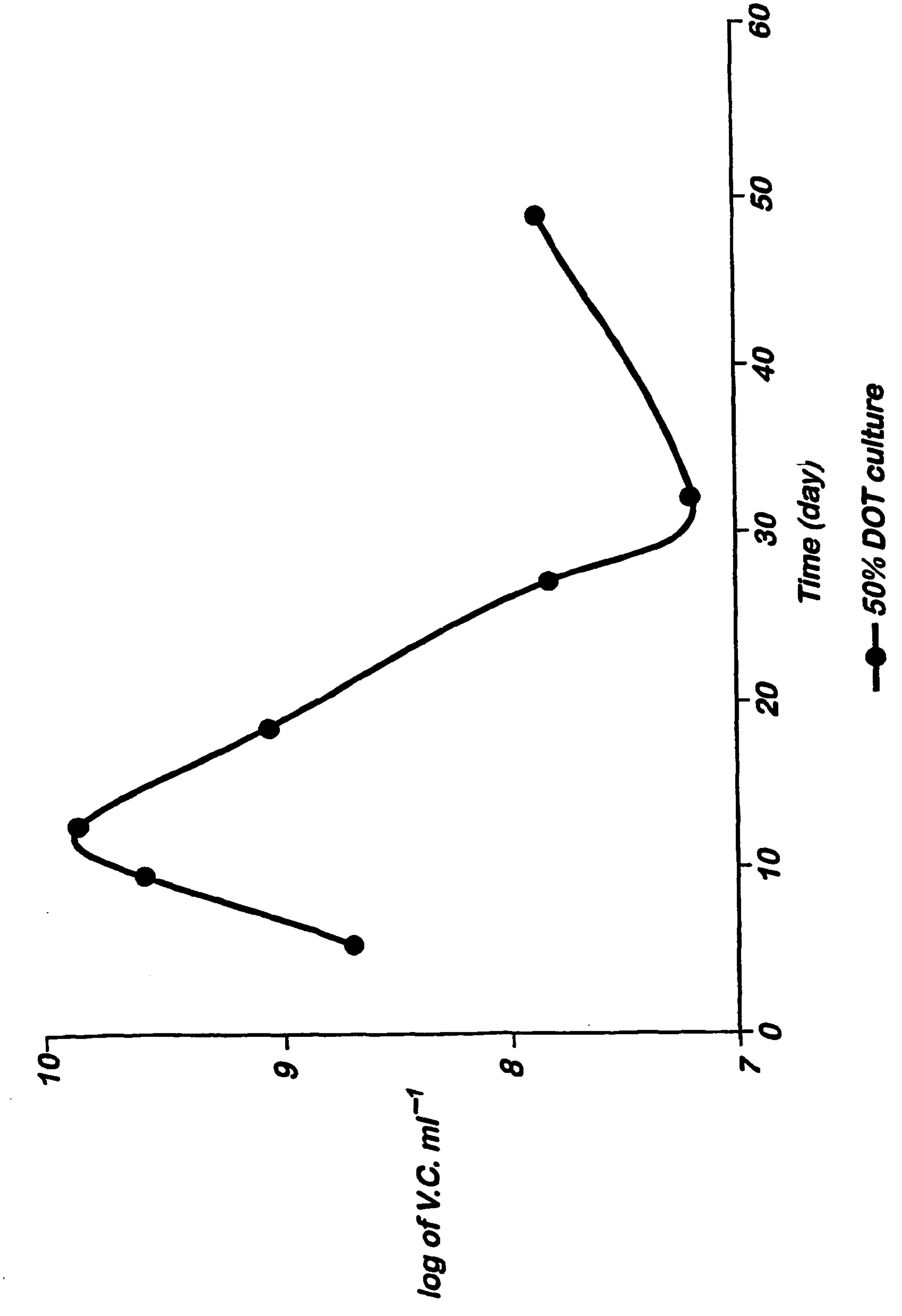
FIG. 1 illustrates the viable counts for *M. tuberculosis* during culture under batch fermentation conditions at a DOT of 50% air saturation (37° C.)

Two alternative mycobacterial culture methods have been employed to study genes which are up-regulated or induced during mycobacterial latency.

Model 1—In vitro Model of Mycobacterial Persistence Under Aerobic, Nutrient-starved Conditions Materials and Methods Strain Studies were performed with *M. tuberculosis* strain H37Rv (NCTC cat. no. 7416)—a representative strain of *M. tuberculosis*. Stock cultures were grown on Middlebrook 7H10+OADC for 3 weeks at 37±2° C.

Culture Medium

Persistence cultures were established in Middlebrook 7H9 medium supplemented with Middlebrook ADC enrichment, 0.2% Tween 80 and 0.2% glycerol (Table 1). The medium was prepared with high quality water from a Millipore water purification system and filter sterilized by passage through a 0.1 μm pore size cellulose acetate membrane filter capsule (Sartorius Ltd). The pH was adjusted to 6.6 with concentrated hydrochloric acid.

Middlebrook 7H10+OADC agar was used to prepare inoculum cultures, enumerate the number of culturable bacteria in samples, and to assess culture purity.

Culture System

We previously developed a process for the culture of *mycobacteria* under controlled and defined conditions—patent application No. PCT/GB00/00760 (WO00/52139). We used this culture system operated as a batch fermenter for the following studies of mycobacterial persistence.

Culture experiments were performed in a one liter glass vessel operated at a working volume of 750 ml. The culture was agitated by a magnetic bar placed in the culture vessel coupled to a magnetic stirrer positioned beneath the vessel. Culture conditions were continuously monitored by an Anglicon Microlab Fermentation System (Brighton Systems, Newhaven), linked to sensor probes inserted into the culture through sealed ports in the top plate. The oxygen concentration was monitored with a galvanic oxygen electrode (Uniprobe, Cardiff) and was controlled through sparging the culture with a mixture of air and oxygen free-nitrogen. Temperature was monitored by an Anglicon temperature probe, and maintained by a heating pad positioned beneath the culture vessel. Culture pH was measured using an Ingold pH electrode (Mettler-Toledo, Leicester).

Inoculation and Culture

The vessel was filled with 750 ml of sterile culture medium and parameters were allowed to stabilise stabilize at 37° C.±2° C., pH 6.9±0.3 and a dissolved oxygen tension of approximately 70% air saturation. A dense inoculum suspension was prepared by resuspending Middlebrook agar cultures, grown at 37±2° C. for 3 weeks, in sterile deionized water. The inoculum was aseptically transferred to the culture vessel, to provide an initial culture turbidity of approximately 0.25 at 540 nm.

The culture were maintained at 37° C. with an agitation rate of 500 to 750 rpm. The dissolved oxygen tension was maintained between 50-70% air saturation with the aid of culture sparging. The initial culture pH was set at approximately 6.7 and was monitored through-out the experiment.

The culture was maintained for 50 days and samples were removed regularly to monitor growth and survival, nutrient utilization and gene expression.

Growth and Survival.

Bacterial growth and survival was assessed by determining the number of viable cells in the culture system at specific time points. This was achieved by preparing a decimal dilution series of the sample in sterile water and plating 100 μl aliquots onto Middlebrook 7H10+OADC plates. The plates were incubated at 37° C. for up to 4 weeks before enumerating the number of colonies formed.

Nutrient Utilization

Glycerol is the primary carbon and energy source present in Middlebrook 7H9 medium with ADC, 0.2% Tween and 0.2% Glycerol. The rate at which glycerol was utilized was determined using the Glycerol Determination Kit Cat. No. 148 270 Boehringer Manheim.

Microarray Experiments

RNA was extracted from culture samples collected at different time points during the experiment. A fluorescently-labelled cDNA was then transcribed from each sample of RNA. The cDNA was labelled by the incorporation of either Cy3 or Cy5 labelled dCTP (Dyes are supplied by Amersham Pharmacia Biotech).

Whole *M. tuberculosis* genome arrays were prepared from *M. tuberculosis* genomic DNA using ORF-specific primers. PCR products corresponding to each ORF were spotted in a grid onto a standard glass microscope slide using a BioRobotics microgrid robot (MWG Biotech) at a resolution of >4000 spots/$cm^2$.

In each microarray experiment a whole genome array was hybridized with labelled cDNA from one culture sample (Test sample). Each array was also hybridized with control DNA incorporating a different Cy dye and prepared from DNA extracted from *M. tuberculosis* strain H37Rv (control sample).

Each array was scanned at two different wavelengths corresponding to the excitation maxima of each dye and the intensity of the emitted light was recorded. The ration of the intensity values for the test and control samples was determined for each array.

The slides were scanned using an Affymetrix 428 scanner. The raw data was initially analyzed by ImaGene software. The scanned images were then transferred to another software package known as GeneSpring to analyze the expression of each gene.

Results

After inoculation the culture entered exponential growth and continued to grow exponentially until 10 days after inoculation (see FIG. 1). Cessation of exponential growth coincided with depletion of the primary carbon and energy source—glycerol (see FIG. 2). As the culture entered stationary phase, viability started to decline and continued to decline steadily over the duration of the study. After 40 days in stationary phase, approximately 1% of the culture was still culturable on Middlebrook agar.

The gene expression profiles for samples collect at day 5 and day 50 were compared. Three arrays were prepared for each sample and the ratio of the intensity values for the test and control samples was determined for each array.

Two different approaches were used to analyze the data:—

1. The ratio values for the 3 arrays prepared for: each sample were averaged and compared. Genes which produced intensity ratios that were 3-fold higher on day 50 than on day 5 were selected.

2. Data from each array was treated as a separate data set and self-organizing maps were used to select all the genes that were consistently up-regulated in all 3 arrays at day 50 relative to day 5.

The two data sets were then compared and those genes that were at least 1.5-fold, preferably at least 3-fold up-regulated at day 50, relative to exponential growth at day 5, and which were consistently up-regulated in all 3 arrays (experiments) were selected. The identified sequences (protein, followed by nucleic acid) are presented in Table 2.

Model 2—In vitro Model of Mycobacterial Persistence Under Low Oxygen, and Nutrient-starved Conditions A second model which simulated low-oxygen availability and nutrient depletion has also been developed. This model was established as outlined for Model 1 above, but with the following modifications.

After inoculation, the dissolved oxygen tension (DOT) of the culture was maintained at approximately 40% air saturation at 37° C. until the culture had entered early exponential growth. The DOT was then lowered in increments down to 1% air saturation over a six day period. The culture was then maintained at a DOT of 0-5% until 50 days after inoculation. Samples were collected for analysis, and the identified sequences (protein, followed by nucleic acid) are presented in Table 2.

TABLE 1 liquid medium formulation for persistence cultures - Middlebrook 7H9 medium supplemented with ADC, 0.2% Tween 80 and 0.2% Glycerol

| Composition per liter | | |
|---|---|---|
| $Na_2HPO_4$ | 2.5 | g |
| $KH_2PO_4$ | 1.0 | g |
| Monosodium glutamate | 0.5 | g |
| $(NH_4)_2SO_4$ | 0.5 | g |
| Sodium citrate | 0.1 | g |
| $MgSO_4.7H_2O$ | 0.05 | g |
| Ferric ammonium citrate | 0.04 | g |
| $CuSO_4.5H_2O$ | 1.0 | mg |
| Pyridoxine | 1.0 | mg |
| $ZnSO_4.7H_2O$ | 1.0 | mg |
| Biotin | 0.5 | mg |
| $CaCl_2.2H_2O$ | 0.5 | mg |
| Middlebrook ADC enrichment | 100 | ml |
| Glycerol | 2.0 | ml |
| Tween 80 | 2.0 | ml |
| Middlebrook ADC enrichment - per 100 ml | | |
| Bovine serum albumin | 5.0 | g |
| Glucose | 2.0 | g |
| Catalase | 3.0 | mg |

EXAMPLE 2

RNA Extraction from *M. tuberculosis* for Microarray Analysis

Materials and Methods

Trizol (Life Technologies)—Formulation of Phenol and Guanidine Thiocyanate.

GTC lysis solution containing: 5 M guanidine thiocyanate, 0.5% N-lauryl sarcosine, 25 mM tri-sodium citrate, 0.1 M 2-mercaptoethanol, and 0.5% Tween 80.

Chloroform

Isopropanol 3M sodium acetate

70% Ethanol microfuge ribolyser

Sterile plasticware-Falcon tubes, screw capped eppendorfs, gilson tips—all RNase free Glassware—baked at 160° C. for at least 16 hours Method Steps performed at Containment level 3; within a Class III microbiological safety cabinet.

Remove 10 or 20 ml of culture ($10^9$/ml) and immediately add this to 4 volumes of GTC lysis buffer in a plastic specimen pot. Seal the pot tightly.

Incubate the cells in GTC lysis buffer for 1 hour at room temperature. Surface decontaminate the plastic pot with 5% Hycolin for 5 minutes. Transfer the sample to the pass box and place it into a plastic carry tin with a sealable lid. Close the container securely and transport it to a non-toxic cabinet CL3 cabinet.

Equally distribute the lysis mixture between Falcon tubes. Place these tubes into centrifuge buckets and seal the buckets tightly. Surface-decontaminate the buckets for 5 minutes with 5% Hycolin. Then transfer them to the centrifuge (Baird and Tatlock Mark IV refrigerated bench-top centrifuge). Spin the tubes at 3,000 rpm for 30 minutes.

Return the unopened buckets to the cabinet. Remove the centrifuge tubes and pour the supernatant into a waste bottle for GTC lysis buffer.

Resuspend each pellet in 1 ml of Trizol (formulation of phenol and GTC cat no. 15596-026). The manufacturers guidelines recommend lysing cells by repetitive pipetting. Although this action alone will not lyse *M. tuberculosis*, it is important to completely resuspend the pellet in Trizol.

Transfer 1 ml of cells into a FastRNA tube and ribolyse it at power setting 6.5 for 45 seconds.

Leave the tube to incubate at room temperature for 5 minutes.

Remove the aqueous layer from the tube and add this to 200 µl of chloroform in a screw-capped eppendorf tube. Shake each tube vigorously for about 15 seconds. Incubate for 2-3 minutes at room temperature.

Spin the tube at 13,000 rpm for 15 minutes. Following centrifugation, the liquid separates into red phenol/chloroform phase, an interface, and a clear aqueous phase.

Carefully remove the aqueous phase and transfer it to a fresh eppendorf tube containing 500 µl of chloroform/isoamyl alcohol (24:1). Spin the tubes at 13,000 rpm for 15 minutes.

Transfer the aqueous phase to an eppendorf tube containing 50 µl of sodium acetate and 500 µl of isopropanol.

Surface decontaminate the eppendorf tube with 5% Hycolin for 5 minutes.

Steps Performed at Containment Level 2:

Precipitate the RNA at −70° C. for at least 30 minutes—can do this step overnight.

Spin the precipitated RNA down at 13,000 rpm for 10 minutes. Remove the supernatant and wash the pellet in 70% ethanol. Repeat centrifugation.

Remove the 70% ethanol and air-dry the pellet. Dissolve the pellet in RNAse free water.

Freeze the RNA at −70° C. to store it.

EXAMPLE 3

Isolation of Genomic DNA from *Mycobacterium tuberculosis* Grown in Chemostat Culture. DNA Then Used to Generate Cy3 or Cy5 Labelled DNA for Use as a Control in Microarray Experiments Materials and Methods
Beads 0.5 mm in diameter
Bead beater
Bench top centrifuge
Platform rocker
Heat block
Falcon 50 ml centrifuge tubes
Sorvall RC-5C centrifuge
250 ml polypropylene centrifuge pots.
Screw capped eppendorf tubes
Pipettes 1 ml, 200 μl, 10 ml, 5 ml Breaking Buffer
50 mM Tris HCl pH 8.0
110 mM EDTA
100 mM NaCl Procedure Mechanical Disruption of *M. tuberculosis* Cells 150 ml of chemostat cells (O.D of 2.5 at 540 nm) are spun down at 15,000 rpm for 15 minutes in 250 ml polypropylene pots using centrifuge Sorvall RC-5C.

The supernatant is discarded.

Cells are re-suspended in 5 ml of breaking buffer in a 50 ml Falcon tube and centrifuged at 15,000 rpm for a further 15 minutes.

The supernatant is removed and additional breaking buffer is added at a volume of 5 ml. Beads are used to disrupt the cells. These are used at a quantity of 1 ml of beads for 1 ml of cells. Place the sample into the appropriate sized chamber. Place in the bead beater and secure the outer unit (containing ice) and process at the desired speed for 30 seconds.

Allow the beads to settle for 10 minutes and transfer cell lysate to a 50 ml Falcon centrifuge tube.

Wash beads with 2-5 ml of breaking buffer by pipetting washing buffer up and down over the beads.

Add this washing solution to the lysate in the falcon tube

Removal of Proteins and Cellular Components

Add 0.1 volumes of 10% SDS and 0.01 volumes proteinase K.

Mix by inversion and heat at 55° C. in a heat block for 2-3 hours

The resulting mix should be homogenous and viscous. Additional SDS may be added to assist here to bring the concentration up to 0.2%

Add an equal volume of phenol/chloroform/Isoamyl alcohol in the ratio: 25/24/1.

Gently mix on a platform rocker until homogenous

Spin down at 3,000 rpm for 20 minutes

Remove the aqueous phase and place in a fresh tuber

Extract the aqueous phase with an equal volume of chloroform to remove traces of cell debris and phenol. Chloroform extractions may need to be repeated to remove all the debris.

Precipitate, the DNA with 0.3 M sodium acetate and an equal volume of isopropanol.

Spool as much DNA as you can with a glass rod

Wash the spooled DNA in 70% ethanol followed by 100% ethanol

Leave to air dry

Dissolve the DNA in sterile deionized water (500 μl)

Allow DNA to dissolve at 4° C. for approximately 16 hours.

Add RNase 1 (500 U) to the dissolved DNA

Incubate for 1 hour at 37° C.

Re-extract with an equal volume of phenol/chloroform followed by a chloroform extraction and precipitate as before Spin down the DNA at 13,000 rpm Remove the supernatant and wash the pellet in 70% ethanol Air dry Dissolve in 200-500 μl of sterile water.

EXAMPLE 4

Preparation of Cy3 or Cy5 Labelled DNA from DNA a) Prepare one Cy3 or one Cy5 Labelled DNA Sample per Microarray Slide.

Each sample:

| | |
|---|---|
| DNA | 2-5 μg |
| Random primers (3 μg/μl) | 1 μl |
| $H_2O$ | to 41.5 μl |

Heat at 95° C. for 5 min, snap cool on ice and briefly centrifuge.

Add to each:

10× REact 2 buffer . . . 5 μl dNTPs (5 mM dA/G/TTP, 2 mM dCTP) . . . 1 μl

Cy3 OR Cy5 dCTP . . . 1.5 μl

Klenow (5 U/μl) . . . 1 μl

Incubate at 37° C. in dark for 90 min.

b) Prehybridize Slide

Mix the prehybridization solution in a Coplin jar and incubate at 65° C. during the labelling reaction to equilibrate.

Prehybridization: 20×SSC . . . 8.75 ml (3.5×SSC)

20% SDS . . . 250 μl (0.1% SDS)

BSA (100 mg/ml) . . . 5 ml (10 mg/ml)

$H_2O$ . . . to 50 ml

Incubate the microarray slide in the pre-heated prehybridization solution at 65° C. for 20 min. Rinse slide thoroughly in 400 ml $H_2O$ for 1 min followed by rinse in 400 ml propan-2-ol for 1 min and centrifuge slide in 50 ml centrifuge tube at 1,500 rpm for 5 min to dry. Store slide in dark, dust-free box until hybridization (<1 h).

c) Purify Cy3/Cy5 Labelled DNA—Qiagen MinElute Purification

Combine Cy3 and Cy5 labelled DNA samples in single tube and add 500 μl Buffer PB.

Apply to MinElute column in collection tube and centrifuge at 13,000 rpm for 1 min.

Discard flow-through and place MinElute column back into same collection tube.

Add 500 μl Buffer PE to MinElute column and centrifuge at 13,000 rpm for 1 min.

Discard flow-through and place MinElute column back into same collection tube.

Add 250 μl Buffer PE to MinElute column and centrifuge at 13,000 rpm for 1 min.

Discard flow-through and place MinElute column back into same collection tube.

Centrifuge at 13,000 rpm for an additional 1 min to remove residual ethanol.

Place the MinElute column into a fresh 1.5 ml tube.

Add 10.5 µl $H_2O$ to the centre of the membrane and allow to stand for 1 min.

Centrifuge at 13,000 rpm for 1 min.

EXAMPLE 5

Preparation of Cy3 or Cy5 Label cDNA from RNA a) Prepare One Cy3 and One Cy5 Labelled cDNA Sample Per Microarray Slide Each sample:

RNA . . . 2-10 µg

Random primers (3 µg/µl). . . 1 µl $H_2O$ . . . to 11 µl

Heat at 95° C. for 5 min, snap cool on ice and briefly centrifuge.

Add to each: 5ÎFirst Strand Buffer . . . 5 µl

DTT (100 mM) . . . 2.5 µl dNTPs (5 mM dA/GTTP, 2 mM dCTP) . . . 2.3 µl

Cy3 OR Cy5 dCTP . . . 1.7 µl

SuperScript II (200 U/µl) . . . 2.5 µl

Incubate at 25° C. in dark for 10 min followed by 42° C. in dark for 90 min.

b) Prehybridize slide

Mix the prehybridization solution in a Coplin jar and incubate at 65° C. during the labelling reaction to equilibrate.

Prehybridization: 20×SSC . . . 8.75 ml (3.5×SSC)

20% SDS . . . 250 µl (0.1% SDS)

BSA (100 mg/ml) . . . 5 ml (10 mg/ml)

$H_2O$ . . . to 50 ml

Incubate the microarray slide in the pre-heated prehybridization solution at 65° C. for 20 min. Rinse slide thoroughly in 400 ml $H_2O$ for 1 min followed by rinse in 400 ml propan-2-ol for 1 min and centrifuge slide in 50 ml centrifuge tube at 1,500 rpm for 5 min to dry. Store slide in dark, dust-free box until hybridization (<1 h).

c) Purify Cy3/Cy5 Labelled cDNA—Qiagen MinElute Purification

Combine Cy3 and Cy5 labelled DNA samples in single tube and add 250 µl Buffer PB.

Apply to MinElute column in collection tube and centrifuge at 13,000 rpm for 1 min.

Discard flow-through and place MinElute column back into same collection tube.

Add 500 µl Buffer PE to MinElute column and centrifuge at 13,000 rpm for 1 min.

Discard flow-through and place MinElute column back into same collection tube.

Add 250 µl Buffer PE to MinElute column and centrifuge at 13,000 rpm for 1 min.

Discard flow-through and place MinElute column back into same collection tube.

Centrifuge at 13,000 rpm for an additional 1 min to remove residual ethanol.

Place the MinElute column into a fresh 1.5 ml tube.

Add 10.5 µl $H_2O$ to the centre of the membrane and allow to stand for 1 min.

Centrifuge at 13,000 rpm for 1 min.

EXAMPLE 6

Hybridize Slide with Cy3/Cy5 Labelled cDNA

Place the prehybridize microarray slide in the hybridization cassette and add two 15 ml aliquots of $H_2O$ to the wells in the cassette. Mix resuspended Cy3/Cy5 labelled cDNA sample with hybridization solution.

Hybridization: Cy3/Cy5 labelled cDNA sample . . . 10.5 ml

20×SSC . . . 3.2 ml (4×SSC)

2% SDS . . . 2.3 ml (0.3% SDS)

Heat hybridization solution at 95° C. for 2 min. Do not snap cool on ice but allow to cool slightly and briefly centrifuge. Pipette the hybridization solution onto the slide at the edge of the arrayed area avoiding bubble formation. Using forceps carefully drag the edge of a cover slip along the surface of the slide towards the arrayed area and into the hybridization solution at the edge of the array. Carefully lower the cover slip down over the array avoiding any additional movement once in place. Seal the hybridization cassette and submerge in a water bath at 60° C. for 16-20 h.

Wash slide.

Remove microarray slide from hybridization cassette and initially wash slide carefully in staining trough of Wash A to remove cover slip. Once cover slip is displaced place slide(s) in slide rack and continue agitating in Wash A for a further 2 min.

Wash A: 20×SSC . . . 20 ml. (1×SSC)

20% SDS . . . 1 ml (0.05% SDS)

$H_2O$ . . . to 400 ml

Transfer slide(s) to a clean slide rack and agitate in first trough of Wash B for 2 min. Wash in second trough of Wash B with agitation for 2 min.

Wash B (×2):20×SSC . . . 1.2 ml (0.06×SSC).)

$H_2O$ . . . to 400 ml

Place slide into a 50 ml centrifuge tube and centrifuge at 1500 rpm for 5 mins to dry slide, and then scan fluorescence using a ScanArray 3000 dual-laser confocal scanner and analyze data.

EXAMPLE 7

Preparation of the Arrays

PCR-amplified products are generated from *M. tuberculosis* genomic DNA using ORF-specific primers. Each gene of the genome is represented. These are spotted in a grid onto a standard glass microscope slide using a BioRobotics microgrid robot (MWG Biotech) at a resolution of >4000 spots/$cm^2$.

EXAMPLE 8

Scanning and Analysis of Data

The slides were scanned using an Affymetrix 428 scanner.

Dual fluorescence is used, allowing simultaneous detection of two cDNA samples. The output of the arrays is read using a confocal laser scanner (Affimetrix 428 scanner from MWG Biotech). More detailed information can be found in Mujumdar, R. B. (1993) Bioconjugate Chemistry, 4(2), pp. 105-111; Yu, H. (1994) Nucl. Acids Res. 22, pp. 3226-3232; and Zhu, Z. (1994) Nucl. Acids Res. 22, pp. 3418-3422.

The raw data were initially analyzed in software known as ImaGene, which was supplied with the scanner. The scanned images were then transferred to another software package known as GeneSpring. This is a very powerful tool, which draws information from many databases allowing the complete analysis of the expression of each gene.

EXAMPLE 9

Delete One or More of the Genes from *M. tuberculosis* in Order to Attenuate its Virulence While Retaining Immunogenicity One or more genes that are identified may be disrupted using allelic exchange. In brief, the gene of interest is cloned with 1-2 kb of flanking DNA either side and is inactivated by deletion of part of the coding region and insertion of an antibiotic resistance marker, such as hygromycin.

The manipulated fragment is then transferred to a suitable suicide vector e.g. pPR23 and is transformed into the wild-type parent strain of *M. tuberculosis.* Mutants are recovered by selecting for antibiotic resistant strains. Genotypic analysis (Southern Blotting with a fragment specific to the gene of interest) is performed on the selected strains to confirm that the gene has been disrupted.

The mutant strain is then studied to determine the effect of the gene disruption on the phenotype. In order to use it as a vaccine candidate it would be necessary to demonstrated attenuated virulence. This can be done using either a guinea pig or mouse model of infection. Animals are infected with the mutant strain and the progression of disease is monitored by determining the bacterial load in different organs, in particular the lung and spleen, at specific time points post infection, typically up to 16 weeks.

Comparison is made to animals infected with the wild-type strain which should have a significantly higher bacterial load in the different organs. Long-term survival studies and histopathology can also be used to assess virulence and pathogenicity.

Once attenuated virulence has been established, protection and immunogenicity studies can be performed to assess the potential of the strain as a vaccine. Suitable references for allelic exchange and preparation of TB mutants are McKinney et al., 2000 and Pelicic et al., 1997, [1, 2].

EXAMPLE 10

Select One or More of the Genes Identifiable by the Present Invention, Which Encode Proteins that are Immunogenic, and Put Them into BCG or an Attenuated Strain of *M. tuberculosis* to Enhance its Overall Immunogenicity The gene of interest is amplified from the *M. tuberculosis* genome by PCR. The amplified product is purified and cloned into a plasmid (pMV306) that integrates site specifically into the mycobacterial genome at the attachment site (attB) for mycobacteriophage L5 [3].

BCG is transformed with the plasmid by electroporation, which involves damaging the cell envelope with high voltage electrical pulses, resulting in uptake of the DNA. The plasmid integrates into the BCG chromosome at the attB site generating stable recombinants. Recombinants are selected and are checked by PCR or Southern blotting to ensure that the gene has been integrated. The recombinant strain is then used for protection studies.

EXAMPLE 11

Use of Recombinant Carriers Such as Attenuated *Salmonella* and the Vaccinia Virus to Express and Present TB Genes One of the best examples of this type of approach is the use of Modified Vaccinia virus Ankara (MVA) [4]. The gene of interest is cloned into a vaccinia virus shuttle vector, e.g. pSC11. Baby Hamster Kidney (BHK) cells are then infected with wild-type MVA and are transfected with the recombinant shuttle vector. Recombinant virus is then selected using a suitable selection marker and viral plaques, selected and purified.

Recombinant virus is normally delivered as part of a prime-boost regime where animals are vaccinated initially with a DNA vaccine encoding the TB genes of interest under the control of a constitutive promoter. The immune response is boosted by administering recombinant MVA carrying the genes of interest to the animals at least 2 weeks later.

EXAMPLE 12

Sub-unit Vaccines Containing a Single Peptide/Protein or a Combination of Proteins To prepare sub-unit vaccines with one or more peptides or proteins it is first of all necessary to obtain a supply of protein or peptide to prepare the vaccine. Up to now, this has mainly been achieved in mycobacterial studies by purifying proteins of interest from TB culture. However, it is becoming more common to clone the gene of interest and produce a recombinant protein.

The coding sequence for the gene of interest is amplified by PCR with restriction sites inserted at the *N terminus* and *C terminus* to permit cloning in-frame into a protein expression vector such as pET-15b. The gene is inserted behind an inducible promoter such as lacZ. The vector is then transformed into *E. coli* which is grown in culture. The recombinant protein is over-expressed and is purified.

One of the common purification methods is to produce a recombinant protein with an N-terminal His-tag. The protein can then be purified on the basis of the affinity of the His-tag for metal ions on a Ni-NTA column after which the His-tag is cleaved. The purified protein is then administered to animals in a suitable, adjuvant [5].

EXAMPLE 13

Plasmid DNA Vaccines Carrying One or More of the Identified Genes

DNA encoding a specific gene is amplified by PCR, purified and inserted into specialized vectors developed for vaccine development, such as pVAX1. These vectors contain promoter sequences, which direct strong expression of the introduced DNA (encoding candidate antigens) in eukaryotic cells (e.g. CMV or SV40 promoters), and polyadenlyation signals (e.g. SV40 or bovine growth hormone) to stabilize the mRNA transcript.

The vector is transformed into *E. coli* and transformants are selected using a marker, such as kanamycin resistance, encoded by the plasmid. The plasmid is then recovered from transformed colonies and is sequenced to check that the gene of interest is present and encoded properly without PCR generated mutations.

Large quantities of the plasmid is then produced in *E. coli* and the plasmid is recovered and purified using commercially available kits (e.g. Qiagen Endofree-plasmid preparation). The vaccine is then administered to animals for example by intramuscular injection in the presence or absence of an adjuvant.

EXAMPLE 14

Preparation of DNA Expression Vectors

DNA vaccines consist of a nucleic acid sequence of the present invention cloned into a bacterial plasmid. The plasmid vector pVAX1 is commonly used in the preparation of DNA vaccines. The vector is designed to facilitate high copy number replication in *E. coli* and high level transient expression of the peptide of interest in most mammalian cells. For details see manufacturers protocol for pVAX1 (catalog no. V260-20).

The vector contains the following elements:—

- Human cytomegalovirus immediate-early (CMV) promoter for high-level expression in a variety of mammalian cells
- T7 promoter/priming site to allow in vitro transcription in the sense orientation and sequencing through the insert
- Bovine growth hormone (BGH) polyadenylation signal for efficient transcription termination and polyadenylation of mRNA
- Kanamycin resistance gene for selection in *E. coli*
- A multiple cloning site
- pUC origin for high-copy number replication and growth in *E. coli*
- BGH reverse priming site to permit sequencing through the insert Vectors may be prepared by means of standard recombinant techniques which are known in the art, for example Sambrook et al., (1989). Key stages in preparing the vaccine are as follows:

- The gene of interest is ligated into pVAX1 via one of the multiple cloning sites
- The ligation mixture is then transformed into a competent *E. coli* strain (e.g. TOP10) and LB plates containing 50 μg/ml kanamycin are used to select transformants.
- Clones are selected and may be sequenced to confirm the presence and orientation of the gene of interest.
- Once the presence of the gene has been verified, the vector can be used to transfect a mammalian cell line to check for protein expression. Methods for transfection are known in the art and include, for example, electroporation, calcium phosphate, and lipofection.
- Once peptide expression has been confirmed, large quantities of the vector can be produced and purified from the appropriate cell host, e.g. *E. coli.* pVAX1 does not integrate into the host chromosome. All non-essential sequences have been removed to minimize the possibility of integration. When constructing a specific vector, a leader sequence may be included to direct secretion of the encoded protein when expressed inside the eukaryotic cell.

Other examples of vectors that have been used are V1Jns.tPA and pCMV4 (Lefevre et al., 2000 and Vordermeier et al., 2000).

Expression vectors may be used that integrate into the genome of the host, however, it is more common and more preferable to use a vector that does not integrate. The example provided, pVAX1, does not integrate. Integration would lead to the generation of a genetically modified host which raises other issues.

EXAMPLE 15

RNA Vaccine

As discussed on page 15 of U.S. Pat. No. 5,783,386, one approach is to introduce RNA directly into the host.

Thus, the vector construct (Example 10) may be used to generate RNA in vitro and the purified RNA then injected into the host. The RNA would then serve as a template for translation in the host cell. Integration would not occur.

Another option is to use an infectious agent such as the retroviral genome carrying RNA corresponding to the gene of interest. Here you will get integration into the host genome Another option is the use of RNA replicon vaccines which can be derived from virus vectors such as Sindbis virus or Semliki Forest virus. These vaccines are self-replicating and self-limiting and may be administered as either RNA or DNA which is then transcribed into RNA replicons in vivo. The vector eventually causes lysis of the transfected cells thereby reducing concerns about integration into the, host genome. Protocols for RNA vaccine construction are detailed in Cheng et al., (2001).

EXAMPLE 16

Diagnostic Assays Based on Assessing T Cell Responses

For a diagnostic assay based on assessing T cell responses it would be sufficient to obtain a sample of blood from the patient. Mononuclear cells (monocytes, T and B lymphocytes) can be separated from the blood using density gradients such as Ficoll gradients.

Both monocytes and B-limphocytes are able to present antigen, although less efficiently than professional antigen presenting cells (APCs) such as dendritic cells. The latter are more localized in lymphoid tissue.

The simplest approach would be to add antigen to the separated mononuclear cells and incubate for a week and then assess the amount of proliferation. If the individual had been exposed to the antigen previously through infection, then T-cell clones specific to the antigen should be more prevalent in the sample and should respond.

It is also possible to separate the different cellular populations should it be desired to control the ratio of T cells to APC's.

Another variation of this type of assay is to measure cytokine production by the responding lymphocytes as a measure of response. The ELISPOT assay described below in Example 17 is a suitable example of this variation.

EXAMPLE 17

Detection of Latent *Mycobacteria*

A major problem for the control of tuberculosis is the presence of a large reservoir of asymptomatic individuals infected with tubercle *bacilli*. Dormant *bacilli* are more resistant to front-line drugs.

The presence of latent *mycobacteria*-associated antigen may be detected indirectly either by detecting antigen specific antibody or T-cells in blood samples.

The following method is based on the method described in Lalvani et al. (2001) in which a secreted antigen, ESAT-6, was identified as being expressed by members of the *M. tuberculosis* complex but is absent from *M. bovis* BCG vaccine strains and most environmental *mycobacteria.* 60-80% of patients also have a strong *cellular* immune response to ESAT-6. An ex-vivo ELISPOT assay was used to detect ESAT-6 specific T cells.

As applied to the present invention:

A 96 well plate is coated with cytokine (e.g. interferon-γ, IL-2)-specific antibody. Peripheral blood monocytes are then isolated from patient whole blood and are applied to the wells.

Antigen (ie. one of the peptides, fragments, derivatives or variants of the present invention) is added to stimulate specific T cells that may be present and the plates are incubated for 24 h. The antigen stimulates cytokine production which then binds to the specific antibody.

The plates are washed leaving a footprint where antigen-specific T cells were present.

A second antibody coupled with a suitable detection system, e.g. enzyme, is then added and the number of spots are enumerated after the appropriate substrate has been added.

The number of spots, each corresponding to a single antigen-specific T cell, is related to the total number of cells originally added.

The above Example also describes use of an antigen that may be used to distinguish TB infected individuals from BCG vaccinated individuals. This could be used in a more discriminative diagnostic assay.

EXAMPLE 18

In vitro Model for Mycobacterial Persistence Under the Joint Conditions of Carbon-starvation and Oxygen-limitation ( Variation on Examples 1-7)

Materials and Methods

Strain

Studies were performed with *M. tuberculosis* strain H37Rv (NCTC cat. No. 7416)—a representative strain of *M. tuberculosis.* Stock cultures were grown on Middlebrook 7H10+ OADC for 3 weeks at 37±2° C.

Culture Medium

Persistence cultures were established in Middlebrook 7H9 medium supplemented with Middlebrook ADC enrichment, 0.2% Tween 80 and 0.2% glycerol (see below). The medium was prepared with high quality water from a Millipore water purification system and filter sterilized by passage through a 0.1 um pore size cellulose acetate membrane filter capsule (Sartorius Ltd). The pH was adjusted to 6.6 with concentrated hydrochloric acid.

Middlebrook 7H10+OADC agar was used to prepare inoculum cultures, enumerate the number of culturable bacteria in samples, and to assess culture purity.

Culture System

The culture system described in WO00/52139, operated as a batch fermenter, was employed for this Example.

Culture experiments were performed in a one liter glass vessel operated at a working volume of 750 ml. The culture was agitated by a magnetic bar placed in the culture vessel coupled to a magnetic stirrer positioned beneath the vessel. Culture conditions were continuously monitored by an Anglicon Microlab Fermentation System (Brighton Systems, Newhaven), linked to sensor probes inserted into the culture through sealed ports in the top plate. The oxygen concentration was monitored with a galvanic oxygen electrode (Uniprobe, Cardiff) and was controlled through sparging the culture with a mixture of air and oxygen free-nitrogen. Temperature was monitored by an Anglicon temperature probe, and maintained by a heating pad positioned beneath the culture vessel. Culture pH was measured using an Ingold pH electrode (Mettler-Toledo, Leicester).

Inoculation and Culture

The vessel was filled with 750 ml of sterile culture medium and parameters were allowed to stabilize at 37° C.±2 C, pH 6.9±0.3 and a dissolved oxygen tension of approximately 70% air saturation. A dense inoculum suspension was prepared by resuspending Middlebrook agar cultures, grown at 37° C. for 3 week, in sterile deionized water. The inoculum was aseptically transferred to the culture vessel, to provide an initial culture turbidity of approximately 0.25 at 540 nm. The culture was maintained at 37° C. with an agitation rate of 500 to 750 rpm.

Figure 3:
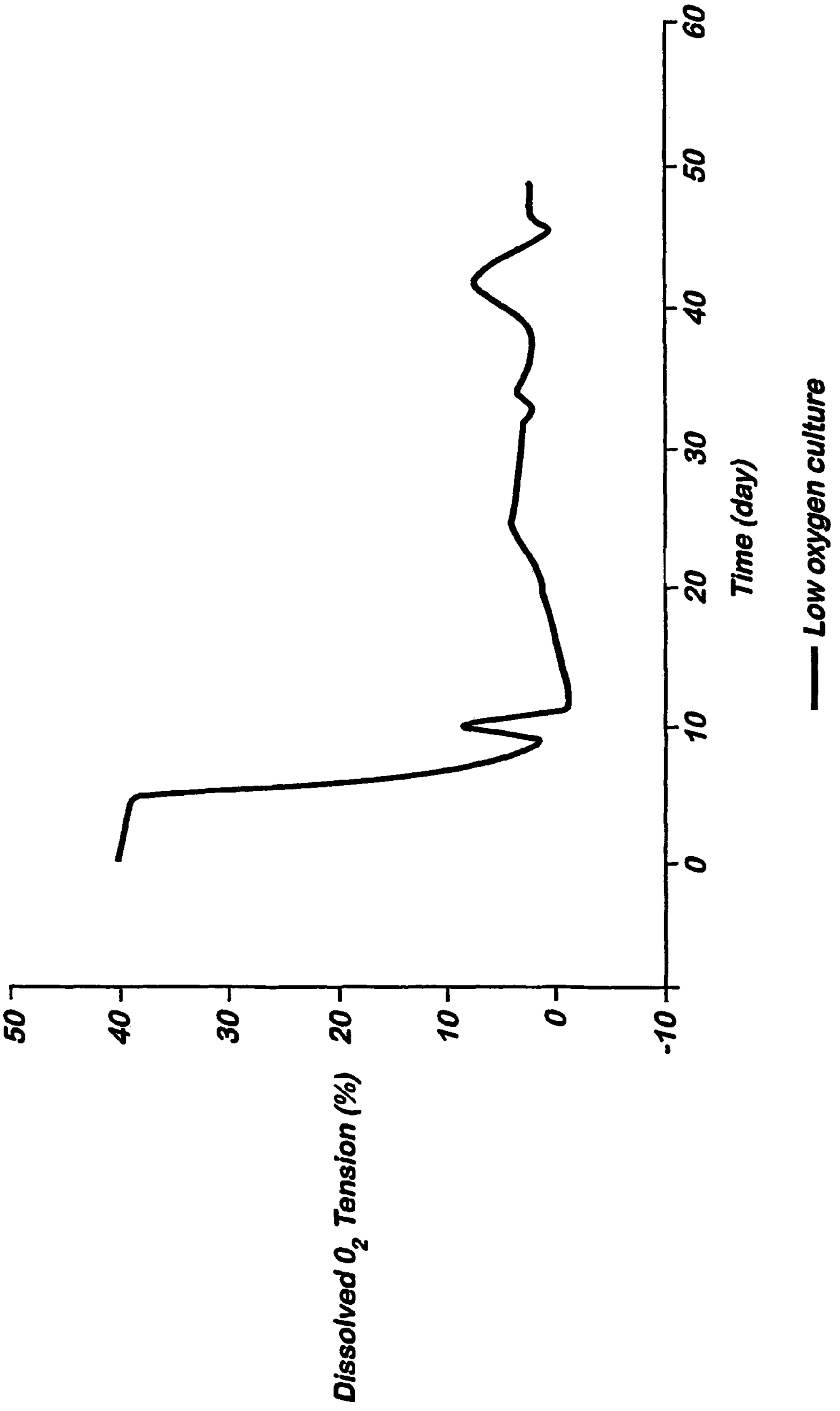
FIG. 3 illustrates the DOT within the medium of the mycobacterial culture described in Example 18.

After inoculation, the dissolved oxygen tension (DOT) of the culture was maintained at approximately 40% air saturation at 37° C. until the culture had entered early exponential growth. The DOT was then lowered in increments down to 1% air saturation over a six day period (FIG. 3). The culture was then maintained at a DOT of 0-5% until 50 days after inoculation and samples were removed regularly to monitor growth and survival, nutrient utilization and gene expression.

Growth and Survival

Bacterial growth and survival was assessed by determining the number of viable cells in the culture system at specific time points. This was achieved by preparing a decimal dilution series of the sample in sterile water and plating 100 μl aliquots onto Middlebrook 7H10+OADC plates. The plates were incubated at 37° C. for up to 4 weeks before enumerating the number of colonies formed.

Nutrient Utilization

Glycerol is the primary carbon and energy source present in Middlebrook 7H9 medium with ADC, 0.2% Tween and Glycerol. The rate at which glycerol was utilized was determined using the Glycerol Determination Kit Cat. No. 148 270 Boehringer Mannheim.

Microarray Experiments

RNA was extracted from culture samples collected at different time points during the experiment. A fluorescently-labelled cDNA was then transcribed from each sample of RNA. The cDNA was labelled by the incorporation of either Cy3 or Cy5 labelled dCTP (Dyes are supplied by Amersham Pharmacia Biotech).

Whole *M. tuberculosis* genome arrays were prepared from *M. tuberculosis* genomic DNA using ORF-specific primers. PCR products corresponding to each ORF were spotted in a grid onto a standard glass microscope slide using a BioRobotics microgrid robot (MWG Biotech) at a resolution of >4000 spots/$cm^2$.

Arrays were supplied by Dr P Butcher, St George's Hospital Medical School London.

In each microarray experiment a whole genome array was hybridized with labelled cDNA from one culture sample (Test sample). Each array was also hybridized with control DNA incorporating a different Cy dye and prepared from DNA extracted from *M. tuberculosis* strain H37Rv (control sample). Each array was scanned, using an Affymetrix 428 scanner, at two different wavelengths corresponding to the excitation maxima of each dye and the intensity of the emitted light was recorded. The raw data was processed by ImaGene software before performing comparative analysis using GeneSpring.

Results

Figure 2:
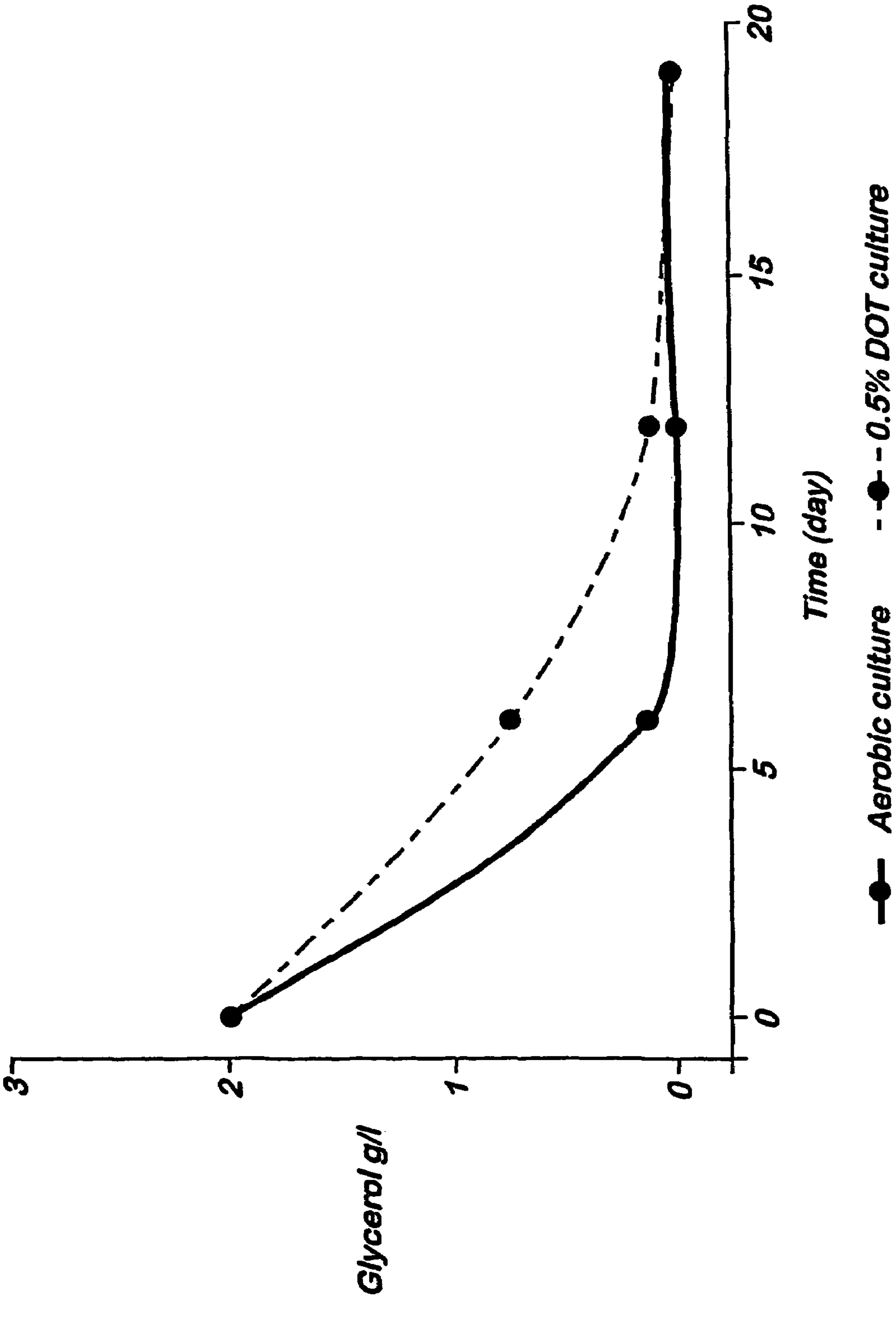
FIG. 2 illustrates the concentration of glycerol (as the primary carbon and energy source during culture of *M. tuberculosis* under batch fermentation conditions at a DOT of 50% air saturation (37° C.).
Figure 4:
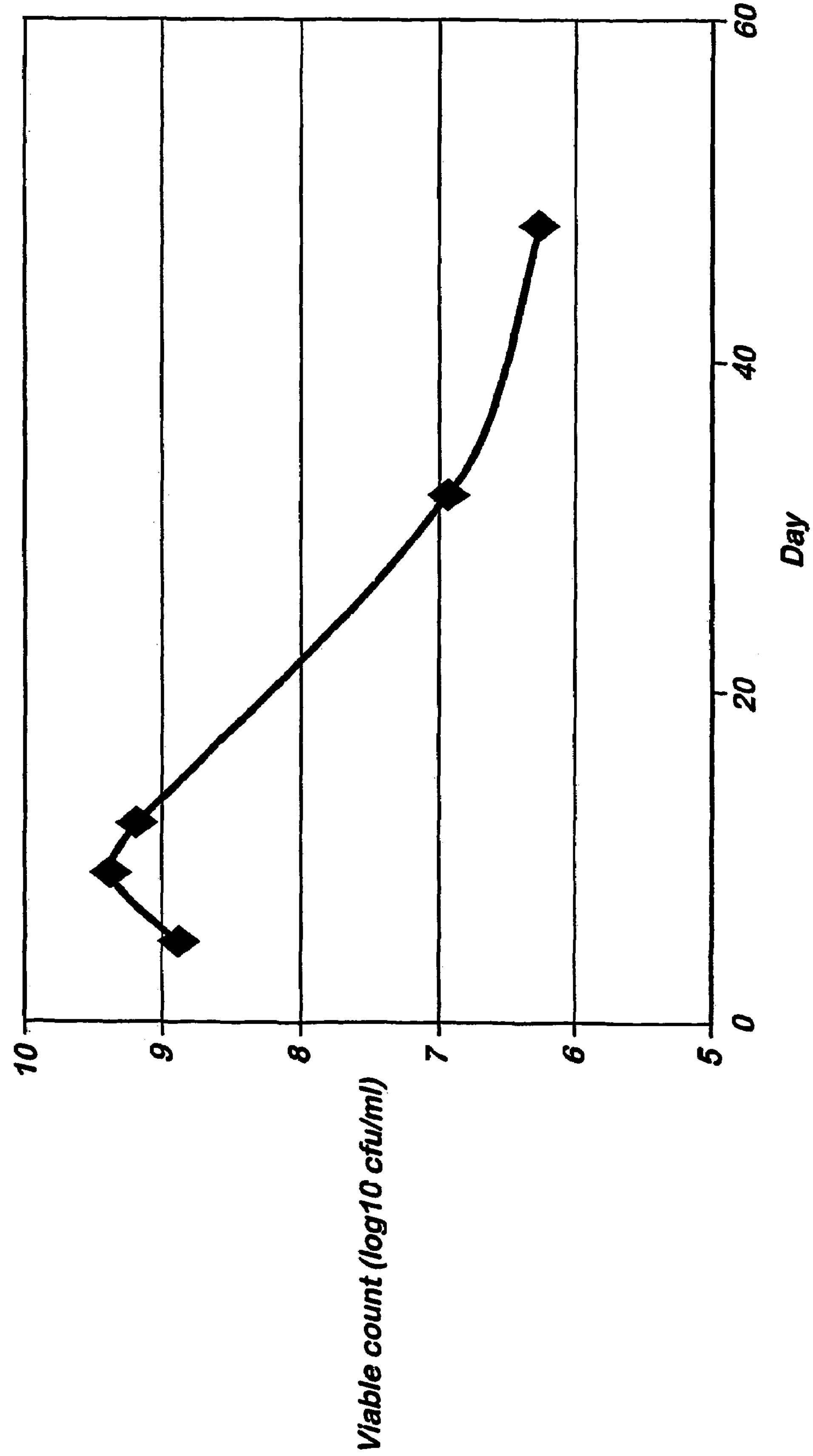
FIG. 4 illustrates the viable counts for *M. tuberculosis* during the batch fermentation conditions of Example 18 (ie. carbon-starvation, and oxygen limiting conditions).

Analysis of viable count data indicated that the culture grew exponentially until 10 to 12 days post infection (FIG. 4). As the culture entered stationary phase, viability started to decline and continued to decline steadily over the duration of the study. After 40 days in stationary phase, approximately 0.1% of the culture was still culturable on Middlebrook agar. The rate of glycerol utilization was slower than observed in the culture established under aerobic conditions, indicating that the metabolic activity of the low-oxygen culture was restricted by limited oxygen availability. Nevertheless, the principal carbon and energy source was depleted within 15 days after inoculation (FIG. 2).

Samples were collected for microarray analysis as outlined. The gene expression profiles for samples collected at day 5 and 50 were compared. Three arrays were prepared for each sample and the test data was normalized against the control data on each chip. The normalized data for each set of arrays was then averaged and the two data sets were compared. Those genes that were expressed at least 1.5-fold, preferably at least 5-fold higher at day 50 relative to day 5 were selected. The gene list was then added to those genes identified under "nutrient- starving" conditions, and the complete set listed in Table 2.

Liquid medium formulation for persistence cultures—Middlebrook 7H9 medium supplemented with ADC, 0.2% Tween 80 and 0.2% Glycerol Composition Per Liter:

| Composition per litre: | |
|---|---|
| $Na_2HPO_4$ | 2.5 g |
| $KH_2PO_4$ | 1.0 g |
| Monosodium glutamate | 0.5 g |
| $(NH4)_2SO_4$ | 0.5 g |
| Sodium citrate | 0.1 g |
| $MgSO_4.7H_2O$ | 0.05 g |
| Ferric ammonium citrate | 0.04 g |
| $CuSO_4.5H_2O$ | 1.0 mg |
| Pyridoxine | 1.0 mg |
| $ZnSO_4.7H_2O$ | 1.0 mg |
| Biotin | 0.5 mg |
| $CaCl_2.2H_2O$ | 0.5 mg |
| Middlebrook ADC enrichment | 100 ml |
| Glycerol | 2.0 ml |
| Tween 80 | 2.0 ml |
| Middlebrook ADC enrichment - per 100 ml | |
| Bovine serum albumin | 5.0 g |
| Glucose | 2.0 g |
| Catalase | 3.0 mg |

Microarray Protocols

1. RNA Extraction from *M. tuberculosis* for Microarray Analysis

Materials and Methods

Trizol (Life Technologies) formulation of phenol and guanidine thiocyanate.

GTC lysis solution containing: 5 M guanidine thiocyanate, 0.5% N-lauryl sarcosine, 25 mM tri-sodium citrate, 0.1 M 2-mercaptoeathanol, and 0.5% Tween 80.

Chloroform

Isopropanol

3 M sodium acetate

70% Ethanol microfuge ribolyser

Sterile plasticware-Falcon tubes, screw capped eppendorfs, gilson tips—all RNase free Glassware—baked at 160° C. for at least 16 hours Method Steps performed at Containment level 3; within a Class III microbiological safety cabinet.

Remove 10 or 20 ml of culture ($10^9$/ml) and immediately add this to 4 volumes of GTC lysis buffer in a plastic specimen pot. Seal the pot tightly.

Incubate the cells in GTC lysis buffer for 1 hour at room temperature. Surface decontaminate the plastic pot with 5% Hycolin for 5 minutes. Transfer the sample to the pass box and place it into a plastic carry tin with a sealable lid. Close the container securely and transport it to a non-toxic cabinet CL3 cabinet.

Equally distribute the lysis mixture between Falcon tubes. Place these tubes into centrifuge buckets and seal the buckets tightly. Surface-decontaminate the buckets for 5 minutes with 5% Hycolin. Then transfer them to the centrifuge (Baird and Tatlock Mark IV refrigerated bench-top centrifuge). Spin the tubes at 3,000 rpm for 30 minutes.

Return the unopened buckets to the cabinet. Remove the centrifuge tubes and pour the supernatant into a waste bottle for GTC lysis buffer.

Resuspend each pellet in 5 ml of Trizol (formulation of phenol and GTC cat No. 15596-026). The manufacturers guidelines recommend lysing cells by repetitive pipetting. Although this action alone will not lyse *M. tuberculosis,* it is important to completely resuspend the pellet in Trizol.

Transfer 1 ml of cells into each FastRNA tube and ribolyse them at power setting 6.5 for 45 seconds.

Leave the tubes to incubate at room temperature for 5 minutes.

Remove the aqueous layer from each tube and add this to 200 μl of chloroform in a screw-capped eppendorf tube. Shake each tube vigorously for about 15 seconds. Incubate for 2-3 minutes at room temperature.

Spin the tubes at 13,000 rpm for 15 minutes. Following centrifugation, the liquid separates into red phenol/chloroform phase, an interface, and a clear aqueous phase.

Carefully remove the aqueous phase and transfer it to fresh eppendorf tubes containing 500 μl of chloroform/isoamyl alcohol (24:1). Spin the tubes at 13,000 rpm for 15 minutes.

Transfer the aqueous phase to eppendorf tubes containing 50 μl of sodium acetate and 500 μl of isopropanol.

Surface decontaminate the eppendorf tubes with 5% Hycolin for 5 minutes.

Steps performed at Containment level 2:

Precipitate the RNA at −70° C. for at least 30 minutes (optionally overnight).

Spin the precipitated RNA down at 13,000 rpm for 10 minutes. Remove the supernatant and wash the pellet in 70% ethanol. Repeat centrifugation.

Remove the 70% ethanol and air-dry the pellet. Dissolve the pellet in RNAse free water.

Freeze the RNA at −70° C. to store it.

2. Isolation of Genomic DNA from *Mycobacterium tuberculosis* Grown in Chemostat Culture. DNA then Used to Generate Cy3 or Cy5 Labelled DNA for Use as a Control in Microarray Experiments Materials and Methods
Beads 0.5 mm in diameter
Bead beater
Bench top centrifuge
Platform rocker
Heat block
Falcon 50 ml centrifuge tubes
Sorvall RC-5 C centrifuge
250 ml polypropylene centrifuge pots.
Screw capped eppendorf tubes
Pipettes 1 ml, 200 μl, 10 ml, 5 ml Breaking Buffer
50 mM Tris HCL pH 8.0
10 M EDTA
100 mM NaCl Procedure Mechanical Disruption of Mtb Cells 150 ml of chemostat cells (O.D of 2.5 at 540 nm) are spun down at 15,000 rpm for 15 minutes in 250 ml polypropylene pots using centrifuge Sorvall RC-5C.

The supernatant is discarded

Cells are re-suspended in 5 ml of breaking buffer in a 50 ml Falcon tube and centrifuged at 15,000 rpm for a further 15 minutes.

The supernatant is removed and additional breaking buffer is added at a volume of 5 ml. Beads are used to disrupt the cells. These are used at a quantity of 1 ml of beads for 1 ml of cells. Place the sample into the appropriate sized chamber. Place in the bead beater and secure the outer unit (containing ice) and process at the desired speed for 30 seconds.

Allow the beads to settle for 10 minutes and transfer cell lysate to a 50 ml Falcon centrifuge tube Wash beads with 2-5 ml of breaking buffer by pipetting washing buffer up and down over the beads.

Add this washing solution to the lysate in the falcon tube.

Removal of proteins and cellular components.

Add 0.1 volumes of 10% SDS and 0.01 volumes proteinase K.

Mix by inversion and heat at 55° C. in a heat block for 2-3 hours.

The resulting mix should be homogenous and viscous. If it isn't then add more SDS to bring the concentration up to 0.2%

Add an equal volume of phenol/chloroform/Isoamyl alcohol in the ratio: 25/24/1.

Gently mix on a platform rocker until homogenous

Spin down at 3,000 rpm for 20 minutes

Remove the aqueous phase and place in a fresh tube

Extract the aqueous phase with an equal volume of chloroform to remove traces of cell debris and phenol. Chloroform extractions may need to be repeated to remove all the debris.

Precipitate the DNA with 0.3 M sodium acetate and an equal volume of isopropanol.

Spool as much DNA as you can with a glass rod

Wash the spooled DNA in 70% ethanol followed by 100% ethanol

Leave to air dry

Dissolve the DNA in sterile deionized water (500 μl)

Allow DNA to dissolve at 4° C. for approximately 16 hours.

Add RNase 1 (50 U.) to the dissolved DNA

Incubate for 1 hour at 37° C.

Re-extract with an equal volume of phenol/chloroform followed by a chloroform extraction and precipitate as before Spin down the DNA at 13,000 rpm Remove the supernatant and wash the pellet in 70% ethanol Air dry Dissolve in 200-500 μl of sterile water.

3. Preparation of Cy3 or Cy5 Labelled DNA from DNA a) Prepare One Cy3 or One Cy5 Labelled DNA Sample Per Microarray Slide.
Each sample DNA 2-5 μg
Random primers (3 μg/μl) 1 μl
$H_2O$ to 41.5 μl
Heat at 95° C. for 5 min, snap cool on ice and briefly centrifuge.
Add to each: 10*REact 2 buffer . . . 5 μl
dNTPs (5 mM dA/G/TTP, 2 mM dCTP) . . . 1 μl
Cy3 OR Cy5 dCTP . . . 1.5 μl
Klenow (5 U/μl) . . . 1 μl
Incubate at 37° C. in dark for 90 min.

b) Prehybridize Slide

Mix the prehybridization solution in a Coplin jar and incubate at 65° C. during the labelling reaction to equilibrate.

Prehybridization: 20×SSC 8.75 ml (3.5×SSC)
20% SDS 250 μl (0.1% SDS)
BSA (100 mg/ml) 5 ml (10 mg/ml)
$H_2O$ to 50 ml Incubate the microarray slide in the pre-heated prehybridization solution at 65° C. for 20 min. Rinse slide thoroughly in 400 ml $H_2O$ for 1 min followed by rinse in 400 ml propan-2-ol for 1 min and centrifuge slide in 50 ml centrifuge tube at 1,500 rpm for 5 min to dry. Store slide in dark, dust-free box until hybridization (<1 h).

c) Purify Cy3/Cy5 Labelled DNA—Qiagen MinElute Purification

Combine Cy3 and Cy5 labelled DNA samples in single tube and add 500 μl Buffer PB.

Apply to MinElute column in collection tube and centrifuge at 13,000 rpm for 1 min.

Discard flow-through and place MinElute column back into same collection tube.

Add 500 μl Buffer PE to MinElute column and centrifuge at 13,000 rpm for 1 min.

Discard flow-through and place MinElute column back into same collection tube.

Add 250 μl Buffer PE to MinElute column and centrifuge at 13,000 rpm for 1 min.

Discard flow-through and place MinElute column back into same collection tube.

Centrifuge at 13,000 rpm for an additional 1 min to remove residual ethanol.

Place the MinElute column into a fresh 1.5 ml tube.

Add 10.5 μl $H_2O$ to the centre of the membrane and allow to stand for 1 min.

Centrifuge at 13,000 rpm for 1 min.

4. Preparation of Cy3 or Cy5 Label cDNA from RNA a) Prepare One Cy3 and One Cy5 Labelled cDNA Sample Per Microarray Slide.
Each sample: RNA . . . 2-10 μg Random primers (3 μg/μl) . . . . 1 μl
$H_2O$ . . . to 11 μl
Heat at 95° C. for 5 min, snap cool on ice and briefly centrifuge.
Add to each: 5*First Strand Buffer . . . 5 μl
DTT (100 mM) . . . 2.5 μl
dNTPs (5 mM dA/G/TTP, 2 mM dCTP) . . . 2.3 μl
Cy3 OR Cy5 dCTP . . . 1.7 μl
SuperScript II (200 U/μl) . . . 2.5 μl Incubate at 25° C. in dark for 10 min followed by 42° C. in dark for 90 min.

b) Prehybridize Slide

Mix the prehybridization solution in a Coplin jar and incubate at 65° C. during the labelling reaction to equilibrate.

Prehybridization: 20×SSC 8.75 ml (3.5×SSC)
20% SDS 250 μl (0.1% SDS)
BSA (100 mg/ml) 5 ml (10 mg/ml)
$H_2O$ to 50 ml Incubate the microarray slide in the pre-heated prehybridization solution at 65° C. for 20 min. Rinse slide thoroughly in 400 ml $H_2O$ for 1 min followed by rinse in 400 ml propan-2-ol for 1min and centrifuge slide in 50 ml centrifuge tube at 1500 rpm for 5 min to dry. Store slide in dark, dust-free box until hybridization (<1 h).

c) Purify Cy3/Cy5 Labelled cDNA—Qiagen MinElute Purification

Combine Cy3 and Cy5 labelled DNA samples in single tube and add 250 μl Buffer PB.

Apply to MinElute column in collection tube and centrifuge at 13,000 rpm for 1 min.

Discard flow-through and place MinElute column back into same collection tube.

Add 500 μl Buffer PE to MinElute column and centrifuge at 13,000 rpm for 1 min.

Discard flow-through and place MinElute column back into same collection tube.

Add 250 μl Buffer PE to MinElute column and centrifuge at 13,000 rpm for 1 min.

Discard flow-through and place MinElute column back into same collection tube.

Centrifuge at 13,000 rpm for an additional 1 min to remove residual ethanol.

Place the MinElute column into a fresh 1.5 ml tube.

Add 10.5 μl $H_2O$ to the centre of the membrane and allow to stand for 1 min.

Centrifuge at 13,000 rpm for 1 min.

5. Hybridize slide with Cy3/Cy5 labelled cDNA/DNA

Place the prehybridized microarray slide in the hybridization cassette and add two 15 μl d aliquots of $H_2O$ to the wells in the cassette. Mix resuspended Cy3/Cy5 labelled cDNA sample with hybridization solution.

Hybridization:
Cy3/Cy5 labelled cDNA sample 10.5 μl
20×SSC 3.2 μl (4×SSC)
2% SDS 2.3 μl (0.3% SDS)

Heat hybridization solution at 95° C. for 2 min. Do NOT snap cool on ice but allow to cool slightly and briefly centrifuge. Pipette the hybridization solution onto the slide at the edge of the arrayed area avoiding bubble formation. Using forceps carefully drag the edge of a cover slip along the surface of the slide towards the arrayed area and into the hybridization solution at the edge of the array. Carefully lower the cover slip down over the array avoiding any additional movement once in place. Seal the hybridization cassette and submerge in a water bath at 65° C. for 16-20 h.

Wash Slide

Remove microarray slide from hybridization cassette and initially wash slide carefully in staining trough of Wash A, preheated to 65° C., to remove cover slip. Once cover slip is displaced place slide(s) in slide rack and continue agitating in Wash A for a further 2 min.

Wash A: 20×SSC . . . 20 ml (1×SSC)
20% SDS . . . 1 ml (0.05% SDS)
$H_2O$ . . . to 400 ml Transfer slide(s) to a clean slide rack and agitate in first trough of Wash B for 2 min. Wash in second trough of Wash B with agitation for 2 min.

Wash B (×2):20×SSC . . . 1.2 ml (0.06×SSC)
$H_2O$ . . . to 400 ml

Place slide into a 50 ml centrifuge tube and centrifuge at 1500 rpm for 5 mins to dry slide and then scan fluorescence.

TABLE 2

Genes induced or up-regulated under nutrient-starving conditions, or under nutrient-starving and oxygen-limiting conditions.

| Gene | Assigned function | SEQ. ID. NO. |
|---|---|---|
| Rv0021c | 2-nitropropane dioxygenase | 1, 2 |
| Rv0029 | | 3, 4 |
| Rv0076c | peptide with a membrane-spanning domain at its C-terminus | 5, 6 |
| Rv0111 | acetyltransferase | 7, 8 |
| Rv0161 | oxidoreductase | 9, 10 |
| Rv0212c | transcriptional regulator | 11, 12 |
| Rv0228 | acyl transferase | 13, 14 |
| Rv0260c | two-component response regulator | 15, 16 |
| Rv0311 | | 17, 18 |
| Rv0322 | UDP-glucose dehyrogenase | 19, 20 |
| Rv0325 | | 21, 22 |
| Rv0389 | phosphoribosylglycinamide formyltransferase | 23, 24 |
| Rv0390 | | 25, 26 |
| Rv0395 | | 27, 28 |
| Rv0480c | | 29, 30 |
| Rv0493c | | 31, 32 |
| Rv0534c | 1,4-dihydroxy-2-naphthoate octaprenyl | 33, 34 |
| Rv0557 | | 35, 36 |
| Rv0614 | | 37, 38 |
| Rv0621 | peptide containing a membrane-spanning region | 39, 40 |

TABLE 2-continued

Genes induced or up-regulated under nutrient-starving conditions, or under nutrient-starving and oxygen-limiting conditions.

| Gene | Assigned function | SEQ. ID. NO. |
|---|---|---|
| Rv0622 | peptide containing a membrane-spanning region | 41, 42 |
| Rv0697 | gmc-type oxidoreductase | 43, 44 |
| Rv0698 | | 45, 46 |
| Rv0736 | | 47, 48 |
| Rv0751c | 3-hydroxyisobutyrate dehydrogenase; methylmalonate semialdehyde dehydrogenase | 49, 50 |
| Rv0775 | | 51, 52 |
| Rv0776c | | 53, 54 |
| Rv0785 | dehydrogenase | 55, 56 |
| Rv0790c | | 57, 58 |
| Rv0794c | mercuric reductase; glutathione reductase; dihydrolipoamide dehydrogenase | 59, 60 |
| Rv0795 | transposase | 61, 62 |
| Rv0836c | | 63, 64 |
| Rv0837c | | 65, 66 |
| Rv0840c | proline iminopeptidase; prolyl aminopeptidase | 67, 68 |
| Rv0849 | integral membrane transport protein; quinolone efflux pump | 69, 70 |
| Rv0917 | glycine betaine transporter | 71, 72 |
| Rv978c | | 73, 74 |
| Rv1051c | | 75, 76 |
| Rv1056 | | 77, 78 |
| Rv1089 | | 79, 80 |
| Rv1146 | membrane protein | 81, 82 |
| Rv1147 | phosphatidylethanolamine N-methyltransferase | 83, 84 |
| Rv1370c | transposase | 85, 86 |
| Rv1371 | membrane protein | 87, 88 |
| Rv1372 | chalcone synthase 2 | 89, 90 |
| Rv1373 | sulfotransferase | 91, 92 |
| Rv1429 | | 93, 94 |
| Rv1455 | | 95, 96 |
| Rv1482c | | 97, 98 |
| Rv1496 | | 99, 100 |
| Rv1526c | glycosyl transferase | 101, 102 |
| Rv1528c | PKS-associated protein | 103, 104 |
| Rv1552 | fumarate reductase flavoprotein | 105, 106 |
| Rv1569 | 8-amino-7-oxononanoate synthase; aminotransferase class-II pyridoxal-phosphate | 107, 108 |
| Rv1573 | phage phiRv1 protein | 109, 110 |
| Rv1577c | bacteriophage HK97 prohead protease; phage phiRv1 protein | 111, 112 |
| Rv1670 | | 113, 114 |
| Rv1725c | | 115, 116 |
| Rv1730 | penicillin-binding protein | 117, 118 |
| Rv1763 | transposase | 119, 120 |
| Rv1765c | | 121, 122 |
| Rv1777 | cytochrome p450 | 123, 124 |
| Rv1806 | | 125, 126 |
| Rv1866 | fatty acyl-CoA racemase | 127, 128 |
| Rv1917c | | 129, 130 |
| Rv1939 | nitrilotriacetate monooxygenase | 131, 132 |
| Rv2013 | transposase | 133, 134 |
| Rv2027c | histidine kinase response regulator | 135, 136 |
| Rv2086 | transposase | 137, 138 |
| Rv2087 | transposase | 139, 140 |
| Rv2089c | pepQ; peptidase | 141, 142 |
| Rv2091c | peptide containing a transmembrane region | 143, 144 |
| Rv2093c | TatC component of twin-arginine translocation protein export system | 145, 146 |
| Rv2105 | transposase | 147, 148 |
| Rv2168c | transposase | 149, 150 |
| Rv2242 | | 151, 152 |
| Rv2282c | LysR transcription regulator | 153, 154 |
| Rv2292c | | 155, 156 |
| Rv2310 | excisionase | 157, 158 |
| Rv2322c | ornithine aminotransferase | 159, 160 |
| Rv2323c | | 161, 162 |
| Rv2332 | malate oxidoreductase | 163, 164 |
| Rv2400c | thiosulphate-binding protein | 165, 166 |
| Rv2414c | | 167, 168 |
| Rv2437 | | 169, 170 |
| Rv2478c | | 171, 172 |
| Rv2486 | enoyl-coA hydratase | 173, 174 |
| Rv2505c | acyl-CoA synthetase | 175, 176 |
| Rv2529 | methyltransferase | 177, 178 |
| Rv2596 | | 179, 180 |
| Rv2847c | multifunctional enzyme; siroheme synthase | 181, 182 |
| Rv3635 | transmembrane protein | 183, 184 |

TABLE 2-continued

Genes induced or up-regulated under nutrient-starving conditions, or under nutrient-starving and oxygen-limiting conditions.

| Gene | Assigned function | SEQ. ID. NO. |
|---|---|---|
| Rv2643 | membrane protein | 185, 186 |
| Rv2648 | transposase | 187, 188 |
| Rv2655c | | 189, 190 |
| Rv2684 | transmembrane protein; arsenical pump | 191, 192 |
| Rv2687c | regulatory protein | 193, 194 |
| Rv2690c | transport protein; permease | 195, 196 |
| Rv2800 | glutaryl 7-aca acylase | 197, 198 |
| Rv2812 | transposase | 199, 200 |
| Rv2813 | secretion pathway protein | 201, 202 |
| Rv2835c | sn-glycerol-3-phosphate transport system permease protein | 203, 204 |
| Rv2874 | integral membrane protein | 205, 206 |
| Rv2877c | mercury resistance protein | 207, 208 |
| Rv2943 | transposase | 209, 210 |
| Rv2998 | | 211, 212 |
| Rv3015c | | 213, 214 |
| Rv3022c | | 215, 216 |
| Rv3039c | enoyl-CoA hydratase/isomerase | 217, 218 |
| Rv3016c | acyl-CoA dehydrogenase | 219, 220 |
| Rv3064c | | 221, 222 |
| Rv3097c | esterase; lipase | 223, 224 |
| Rv3107c | dehydrogenase | 225, 226 |
| Rv3162c | | 227, 228 |
| Rv3178 | | 229, 230 |
| Rv3184 | transposase | 231, 232 |
| Rv3315c | cytidine deaminase | 233, 234 |
| Rv3322c | methyltransferase | 235, 236 |
| Rv3351c | | 237, 238 |
| Rv3352c | oxidoreductase | 239, 240 |
| Rv3373 | enoyl-CoA hydratase (crotonase) | 241, 242 |
| Rv3439c | | 243, 244 |
| Rv3446c | | 245, 246 |
| Rv3447c | membrane protein | 247, 248 |
| Rv3450c | | 249, 250 |
| Rv3467 | | 251, 252 |
| Rv3505 | acyl-CoA dehydrogenase | 253, 254 |
| Rv3540c | lipid-transfer protein | 255, 256 |
| Rv3546 | acetyl-CoA C-acetyltransferase | 257, 258 |
| Rv3550 | enoyl-CoA hydratase/isomerase | 259, 260 |
| Rv3552 | | 261, 262 |
| Rv3565 | aminotransferase | 263, 264 |
| Rv3596c | hydrolase | 265, 266 |
| Rv3606c | 2-amino-4-hydroxy-6-hydroxymethyldihydropterine pyrophosphokinase | 267, 268 |
| Rv3637 | transposase | 269, 270 |
| Rv3660c | | 271, 272 |
| Rv3745c | | 273, 274 |
| Rv3903c | | 275, 276 |
| Rv0039c | | 277, 278 |
| Rv0903c | | 279, 280 |
| Rv2745c | | 281, 282 |

REFERENCES

1. McKinney, J. D. et al., Persistence of *Mycobacterium tuberculosis* in macrophages and mice requires the glyoxylate shunt enzyme isocitrate lyase [see comments]. Nature, 2000. 406(6797): p. 735-8.
2. Pelicic, V., et al., Efficient allelic exchange and transposon mutagenesis in *Mycobacterium tuberculosis*. Proc Natl Acad Sci USA, 1997. 94(20): p. 10955-60.
3. Lee, M. H., et al., Site-specific integration of mycobacteriophage L5: integration proficient vectors for *Mycobacterium smegmatis, Mycobacterium tuberculosis*, and bacille Calmette-Guerin. Proc Natl Acad Sci USA, 1991. 88(8): p. 3111-5.
4. McShane, H., et al., Enhanced immunogenicity of CD4(+) t-cell responses and protective efficacy of a DNA-modified vaccinia virus Ankara prime-boost vaccination regimen for murine tuberculosis. Infect Immun, 2001. 69(2): p. 681-6.
5. Movahedzadeh, F., M. J. Colston, and E. O. Davis, Characterization of *Mycobacterium tuberculosis* LexA: recognition of a Cheo (*Bacillus*-type SOS) box. Microbiology, 1997. 143(Pt 3): p. 929-36.

ADDITIONAL REFERENCES

Cunningham, A. F. and. C. L. Spreadbury. 1998. Mycobacterial stationary phase induced by low oxygen tension: cell wall thickening and localization of the 16-kilodalton alpha-crystallin homolog. J. Bacteriol. 180:801-808.

Lalvani, A. et al., 2001. Enhanced contact tracing and spatial tracking of *Mycobacterium tuberculosis* infection by enumeration of antigen-specific T cells. The Lancet 357:2017-2021.

Rook, G. A. W. and B. R. Bloom. 1994. Mechanisms of pathogenesis in tuberculosis, pp 460-485. In B. R. Bloom (ed), Tuberculosis—pathogenesis, on and control. ASM Press, Washington D.C.

Wayne, L. G. 1994. Dormancy of *Mycobacterium tuberculosis* and latency of disease. Eur. J. Clin. Microbiol. Infect. Dis. 13:908-914.

Wayne, L. G. and L. G. Hayes. 1996. An in vitro model for sequential, study of shift-down of *Mycobacterium tuberculosis* through two stages of non-replicating persistence. Infect. Immun. 64:2062-2069.

Wayne, L. G. and K. Lin. 1982. Glyoxylate metabolism and adaptation of *Mycobacterium tuberculosis* to survival under anaerobic conditions. Infect. Immun. 37:1042-1049.

Sambrook, J., E. F. Fritsch, and T. Maniatis. 1989. Molecular cloning: a laboratory manual, 2nd ed. Cold Spring Harbour Laboratory Press, Cold Spring Harbour, N.Y.

Lefever, P., O. Denis, L. De Wit, A. Tanghe, P. Vandenbussche, J. Content, and K. Huygen. 2000. Cloning of the gene encoding a 22-kilodalton cell surface antigen of *Mycobacterium bovis* BCG and analysis of its potential for DNA vaccination against tuberculosis. Infection and Immunity. 68:1040-1047.

Vordermeire, H. M., P. J. Cockle, A. O. Whelan, S. Rhodes, M. A. Chambers, D. Clifford, K. Huygen, R. Tascon, D. Lowrie, M. J. Colston, and R. G. Hewinson. 2000. Effective DNA vaccination of cattle with the mycobacterial antigens MPB83 and MPB70 does not compromise the specificity of the comparative intradermal tuberculin skin test. Vaccine. 19:1246-1255.

Cheng, W., C. Hung, C. Chai, K. Hsu, L. He, C. Rice, M. Ling, and T. Wu. 2001. Enhancement of Sindbis virus self-replicating RNA vaccine potency by linkage of *Mycobacterium tuberculosis* heat shock protein 70 gene to an antigen. J. Immunol. 166:6218-6226.

---

SEQUENCE LISTING (282 sequences)

SEQ ID NO: 1 - protein, 322 aa, Mycobacterium tuberculosis
VVLSTAFSQMFGIDYPIVSAPMDLIAGGELAAAVSGAGGLGLIGGGYGDRDWLARQFDLAAGAPVGCGFITWSLARQPQLLDLALQYEPVAVMLSFGDPAVFADAIKSAGTRLVCQIQNRTQAERALQVGADVLVAQGTEAGGHGHGPRSTLTLVPEIVDLVTARGTDIPVIAAGGIADGRGLAAALMLGAAGVLVGTRFYATVEALSTPQARDPLLAATGDDMCRTTIYDQLRRYPWPQGHTMSVLSNALTDQFEDTELDILHREEAMARYWRAVAARDYSIANVTAGQAAGLVNAVLPAADVITGMAQQAARTLTAMRAV

SEQ ID NO: 2 - DNA, 966 bp, Mycobacterium tuberculosis
gtggtgctatcgacggcctttagccagatgttcggaatcgactatccgatagtgtccgcgccaatggacttgatcgccggcggtgagctggctgccgcggtaagtggcgcagggggactcggcctcatcgggggcggctatggggaccgggattggttggcccggcagttcgatctcgccgctggagcgccggtgggctgcgggttcatcacctggtctttggcccgccaaccgcagctgctcgacctcgcgctgcagtatgagccggtggcggtgatgctgtcgttcggggaccccgcggttttcgctgacgccatcaagtccgccggaacgcggttggtctgccagatccaaaaccggacccaggccgagcgagccctgcaggtcggcgccgatgtgttggtggctcagggcaccgaggccggtgggcacggccacggtccacgttccaccctgaccttggtacccgaaatcgtcgacctggtcaccgcgcggggaactgatatcccggtgatcgccgccgggggcatcgccgacggccggggccttgccgccgcgttgatgttgggcgccgccggggtattggtcggtacgcgcttctacgccacggtcgaagcgttatccacaccgcaggcgcgggacccgctgctggcggccactggcgacgacatgtgccgcaccactatctacgatcagctacggcgctatccctggccgcaaggacacacgatgagcgtgctaagcaacgccctcaccgaccaattcgaggacaccgaactcgacattctccatcgcgaagaagccatggccagatattggcgagccgttgctgcgcgtgactacagcatcgccaatgtcaccgccggtcaagccgcgggcctggtcaatgccgtcctgccagccgccgacgtgataaccggtatggcgcaacaagcggcgaggacgctgaccgcgatgcgcgccgtg

SEQ ID NO: 3 - protein, 365 aa, Mycobacterium tuberculosis
VAIFGRWSARQRLRRATRESLTIPTFSSSLDCTTRVIGGLWPAELSSNTAETATLAEHLKADLHRIVGSANDELMVIWRAGMADSTRRAEEDRVIDRARASAMRRVESAMRELRQITGRVPVEIPRMRGAGGSDLDTTRLMPAVTVVQPADQACTDWPVAAAEDDEARLQRLLAFVARQEPRLNWAVGVHADGTTVLVTDVAHGWIPPGIALPEGVRLLAPARRAGRAPELVGITTCCKTYTPGDSLRRAVDSTAPTSSVQPRALPAIAGLSVELGIATQRHDGLPKIVHAMATAAGNGAAAEEVDLLRVHVDTALHHVLAQYPRVDPALLLNCMLLAATERSVTGDPIAANYHFAWFRELDSRR

SEQ ID NO: 4 - DNA, 1095 bp, Mycobacterium tuberculosis
gtggcgatcttcggtcgatggagtgcgcgccagcgactccggagagcgacccgggaatccctcacgattccgacgtttagctcctcgctggattgcaccacacgggtaattggcgggctctggcccgctgagctttcgtctaacaccgccgaaaccgccacgcttgcagaacatctgaaagcggatctgcatcggatagttggttctgccaacgacgagctgatggtcatctggcgtgcggggatggctgattcgacgcgacgcgcagaagaagacagagtgatcgaccgcgcccgcgcgtcggcgatgcgtcgcgtcgagtcggcgatgcgcgagcttcggcagataacggggcgcgttcccgtggaaattccgcgtatgcgcggcgccggcggctcggatctggacacgacacgactcatgccggccgtcacggtagttcagcccgctgaccaggcctgtacggattggccggttgccgccgccgaggatgacgaagcccgactgcagcgcctcctggcgttcgtggctcgtcaggagccacggctgaactgggcggtcggcgttcacgcggacggcacgacggtcctggtcaccgacgtcgcccatggttggatacctccgggcatcgcccttcccgaaggcgtgcgattgttggcaccggcgcgacgcgccggcagagcccccgagttggtcggtatcacgacgtgttgcaagacgtacacccccggtgactcgctgcgtcgggcggtcgattcaaccgcgccgacgtcctcggtgcagccgcgagcgttgccagcgatcgccggcctgagtgtggagctgggcatagcgacccagcggcacgacggcttaccgaagatcgtgcacgccatggccacggcggccggcaacggcgccgccgccgaggaagtcgacctgttgcgggtgcacgtcgataccgcgctccaccacgtcttggcccagtatccccgggtcgatccggcgttactgctcaactgtatgttgttggccgccaccgagcgcagcgtcacgggagacccgatcgcggcgaactatcacttcgcgtggttccgggaactcgattcacgccga

SEQ ID NO: 5 - protein, 129 aa, Mycobacterium tuberculosis
MPAVTTPSNHWGDERRKLSHQPPVRGQILGRRQARRLSQHFARVGVEAPPKRLQEMLLGAPAADEEWTDVKFALIVTQLNHEKRVAKFHRLQRRATHSLICLGLVLVALNFLICLAYIFFSLTQHAAAL

SEQ ID NO: 6 - DNA, 387 bp, Mycobacterium tuberculosis
atgcccgctgtgacgaccccgtccaaccactggggggacgaacgaaggaagctctcgcatcagccaccggtgcggggtcagattcttggccgcaggcaagcccggcggctgagccagcacttcgcgcgggtcggcgtcgaagccccgccgaagcgccttcaggaaatgctgttgggcgctcccgccgccgacgaagaatggaccgacgtcaagttcgcactgatcgtgacccagctgaaccatgagaagcgcgtcgcgaaattccaccgcctacaacgccgagccacgcattcactaatctgtctgggtttggttctcgtggcactgaacttcctgatctgcctcgcctacatcttcttcagcctgacccaacacgccgcagcgttg

SEQ ID NO: 7 - protein, 685 aa, Mycobacterium tuberculosis
VPARSVPRPRWVAPVRRVGRLAVWDRPERRSGIPALDGLRAIAVALVLASHGGIPGMGGGFIGVDAFFVLSGFLITSLLLDELGRTGRIDLSGFWIRRARRLLPALVLMVLTVSAARALFPDQALTGLRSDAIAAFLWTANWRFVAQNTDYFTQGAPPSPLQHTWSLGVEEQYYVVWPLLLIGATLLLAARARRRCRRATVGGVRFAAFLIASLGTMASATAAVAFTSAATRDRIYFGTDTRAQALLIGSAAAALLVRDWPSLNRGWCLIRTRWGRRIARLLPFVGLAGLAVTTHVATGSVGEFRHGLLIVVAGAAVIVVASVAMEQRGAVARILAWRPLVWLGTISYGVYLWHWPIFLALNGQRTGWSGPALFAARCAATVVLAGASWWLIEQPIRRWRPARVPLLPLAAATVASAAAVTMLVVPVGAGPGLREIGLPPGVSAVAAVSPSPPEASQPAPGPRDPNRPFTVSVFGDSIGWTLMHYLPPTPGFRFIDHTVIGCSLVRGTPYRYIGQTLEQRAECDGWPARWSAQVNRDQPDVALLIVGRWETVDRVNEGRWTHIGDPTFDAYLNAELQRALSIVGSTGVRVMVTTVPYSRGGEKPDGRLYPEDQPERVNKWNAMLHNAISQHSNVGMIDLNKKLCPDGVYTAKVDGIKVRSDGVHLTQEGVKWLIPWLEDSVRVAS

SEQ ID NO: 8 - DNA, 2055 bp, Mycobacterium tuberculosis
gtgccggcacgttctgttccccggccccgttgggtggccccggtgcgccgggtcggtcggctggccgtatgggatcggccggagcggcgcagcggaattccagcgttagatggccttcgtgcgatagcggtcgcgctggtactcgccagccatggcggcatccccggtatgggcggcgggttcatcggcgtcgacgccttcttcgtcttgagcggatttctcatcacctcgctgctgctcgacgagctggggcgcaccggtcgtatcgatctgagcgggttctggattcgccgtgcgcggcggctgctgccggcgctggtgctgatggttctcaccgtgagcgccgcacgcgcactatttcctgaccaagctctcaccgggctacggagcgatgcgatcgccgcgttcctatggacggcgaattggcggtttgtggcccaaaataccgattacttcacccagggcgctccaccctcgcccctacagcacacctggtcgttgggggtggaggagcagtattacgttgtctggccactgttgctgatcggggcgacgctactgttggcggcccgggcgaggcgccgttgcagacgggccacggtgggcggggttcggttcgccgcgttcctgattgccagtctcggcacgatggcttccgccaccgccgcggtcgcatttacctcggcggccacccgcgaccggatttacttcggcaccgatacccgtgcgcaggcgttgctgatcggctccgcggcagcggctctgctggtgcgggattggccatcgctgaaccgcgggtggtgcctgatccggactcgctggggacggcggattgcccgtctgttgccgttcgtcgggctggctgggctggcggtgacgactcacgtcgcaacgggcagtgtgggcgagttccgccatggtctgctgatcgtggtggcaggtgcggccgtcatcgtggttgcctcggtagccatggagcagcgcggagcggtggcccgcatcctggcctggcgaccgttggtgtggctgggcaccatatcgtacggcgtctatctgtggcactggccaatctttctggcgctcaacggccaacgtacgggctggtcgggcccggccctgtttgccgctaggtgtgcagccacggtggtgctggccggtgcgtcgtggtggctgatcgagcaacctattcggcgctggcgaccggcacgggttccgctgttgccgctggcagcggcgaccgttgccagcgctgccgccgtgacgatgctcgttgttccggtcggagccggaccggggctacgcgagatcggccttccgcccggcgtttcggcggtcgccgcggtctcgccgtcgccgccggaagcgagtcagcccgcgcccgggccacgagatcccaaccggccgttcaccgtttcggtattcggtgattcgatcgggtggactttgatgcattacctgccgccgactcccggattccggttcatcgaccacaccgtcatcggctgcagcctggtacgcggcacaccgtatcggtacatcggtcaaaccctggagcagagggcggaatgcgacggctggccggccagatggtcggcgcaggtcaaccgggaccaaccggacgttgcgttgctgatcgtcggccgctgggagacggtagaccgggtcaatgaggggcggtggacacatatcggcgacccgaccttcgatgcgtacctcaacgccgagctacagcgagcgctcagcatcgttggatccaccggggttcgagtgatggtcaccaccgtgccctacagccgcggcggcgaaaagccggacggccgcttgtatccggaggatcaacccgagcgtgtgaacaaatggaacgccatgttacataacgccattagccaacactcgaacgtcggaatgatcgacctcaacaaaaagctttgtccagacggcgtttacacggccaaggtcgacggcatcaaggtccgcagtgatggtgttcatctcacccaggaaggcgtgaagtggctgataccgtggcttgaggattcggtgcgggtcgccagt

SEQ ID NO: 9 - protein, 449 aa, Mycobacterium tuberculosis
MLTSLVSAVGSHHVTTDPDVLAGRSVDHTGRYRGRASALVRPGSAEEVAEVLRVCRDAGAYVTVQGGRTSLVAGTVPEHDDVLLSTERLCVVSDVDTVERRIEIGAGVTLAAVQHAASTAGLVFGVDLSARDTATVGGMASTNAGGLRTVRYGNMGEQVVGLDVALPDGTVLRRHSRVRRDNTGYDLPALFVGAEGTLGVITALDLRLHPTPSHRVTAVCGFAELAALVDAGRMFRDVEGIAALELIDGRAAALTREHLGVRPPVEADWLLLVELAADHDQTDRLADLLGGARMCGEPAVGVDAAAQQRLWRTRESLAEVLGVYGPPLKFDVSLPLSAISGFARDAVALVHRHVPDSPEALPLLFGHIGEGNLHLNVLRCPPDREPALYAKMMGLIAECGGNVSSEHGVGSRKRAYLGMSRQANDVAAMRRVKAALDPTGYLNAAVLFD

SEQ ID NO: 10 - DNA, 1347 bp, Mycobacterium tuberculosis
atgctaaccagcttggtgagtgcggtcggatcgcatcacgtcaccaccgaccctgacgtgctggccggccgcagcgtcgaccacaccggccgctatcggggccgggccagcgcgctggtgcggcccggctcggctgaagaggtcgccgaagtgctgcgggtgtgccgggacgctggagcctatgtcaccgttcaaggcggccgcacctcactggtggcgggcaccgttcccgaacacgacgacgtgctgctgtctaccgaacggctttgcgtcgtcagcgatgtcgataccgttgagcgccgaatcgagatcggtgccggggtcacactggccgcggtgcagcacgccgcgtcaacggctgggctggtgttcggcgtggatttgtcggcccgggataccgcgaccgtcggtggcatggcctcgacgaacgccggcggattgcgcacggtccgttacggcaacatgggcgagcaggttgtcgggctagacgtcgcgctgcccgacggtacggtgctgcgccggcacagccgggtgcgtcgcgacaacaccggctacgacctgcccgcgctgttcgtcggggccgaaggcaccctgggggttatcaccgcgctggatctgcggctgcaccccaccccgtcgcatcgggtgacagccgtgtgcgggttcgccgagctggcagcgctggtcgatgccggccgaatgttccgcgacgtggagggcatcgcggcgttggaattgattgacggtcgggccgccgcgctaacccgtgaacatcttggcgttcgcccccccgtcgaggctgactggttgctattggtggaactggccgccgaccacgatcagaccgaccggctcgccgacctgctcggcggtgcacggatgtgcggggagcccgcggtcggtgtggatgccgctgcgcagcaacggttgtggcgcacccgtgaatcgctggccgaggtgctcggtgtgtacggcccgccgctgaagttcgacgtctcgctgccattgtcggcgatcagcggcttcgcccgagatgcggtcgcgttggttcaccgacacgtcccggattctccggaggcgttgccgctgttgttcggtcacatcggtgagggcaacctgcacctgaacgtgctgcgttgcccgcctgatcgggaaccggcgttgtacgcaaagatgatgggcctcatcgccgaatgcggcggtaacgtcagttcagaacatggggtgggcagccgcaagcgtgcctacctgggaatgtcccggcaggccaacgacgtcgccgcgatgcggagggtcaaggcggcgttggacccgaccgggtaccttaacgccgcggtcttgttcgac

SEQ ID NO: 11 - protein, 323 aa, Mycobacterium tuberculosis
VTHGMVLGKFMPPHAGHVYLCEFARRWVDELTIVVGSTAAEPIPGAQRVAWMRELFPFDRVVHLANENPQRPWEHPDFWDIWKASLQGVLATRPDFVFGAEPYNADFAQVLGARFVAVDHGRTVVPVTATDIRADPLGHWQHIPRCVRPAFVKRVSIIGPESTGKTTLAQAVAEKLRTKWVPERAKMLRELNGGSLIGLEWAEIVRGQIASEEALARDADRVLICDTDPLATTVWAEFLAGGCPQELRDLARRPYDLTLLTTPDVPWDADDGRCVPGARGTFFARCEQALRAAGRSFVVITGGWEERLSVSLRAVEELVRARR

SEQ ID NO: 12 - DNA, 969 bp, Mycobacterium tuberculosis
gtgacacacggaatggtgctcggcaagttcatgccgccccatgcgggacacgtctacctttgcgagttcgcgcggcgatgggtggatgagctgaccatcgtcgtcggatcaacggcagcagagccgattccgggcgcccagcgcgttgcatggatgcgggagctgttccccttcgatcgcgtggtccatctggccaacgagaacccgcagcgcccgtgggagcacccggacttctgggacatctggaaggcgagcctgcagggcgtgctggcaacccgccccgacttcgtcttcggtgccgagccctacaacgcggactttgcccaggtcctcggagcgcgtttcgtggcggtcgatcacggtcgcaccgtcgttcccgtgactgcaaccgacatccgcgcggacccgcttggccactggcaacacatcccacggtgcgtgcggccggccttcgtcaaacgcgtgagcatcatcggacccgaatccaccgggaagaccacgctggcacaggcggttgcggaaaagctccgaacgaagtgggtcccggagcgggcgaaaatgttgcgggagctcaatggcggctcactgataggactggagtgggccgaaatcgttcgcggacagatcgcgtcggaggaagccttggctcgtgacgccgatcgcgtcctgatctgcgacacggatccgctcgcgacgaccgtgtgggccgagttcctggcgggcggctgcccgcaagagctccgtgatctagctcggcgtccctacgatctcacactgctcaccacgcccgatgtgccctgggacgccgacgacggacgctgtgtccccggcgcacgcggtacctttttcgcccgctgcgagcaggctctccgcgccgcgggacgatcattcgtggtgatcacgggcggttgggaagagaggctttcggtgtctttgcgcgctgtcgaagaacttgtgcgtgcccgccgc

SEQ ID NO: 13 - protein, 407 aa, Mycobacterium tuberculosis
MGPADESGAPIRPQTPHRHTVLVTNGQVVGGTRGFLPAVEGMRACAAVGVVVTHVAFQTGHSSGVGGRLFGRFDLAVAVFFAVSGFLLWRGHAAAARDLRSHPRTGPYLRSRVARIMPAYVVAVVVILSLLPDADHASLTVWLANLTLTQIYVPLTLTGGLTQMWSLSVEVAFYAALPVLALLGRRIPVGARVPAIAALAALSWAWGWLPLDAGSGINPLTWPPAFFSWFAAGMLLAEWAYSPVGLPHRWARRRVAMAVTALLGYLVAASPLAGPEGLVPGTAAQFAVKTAMGSLVAFALVAPLVLDRPDTSHRLLGSPAMVTLGRWSYGLFIWHLAALAMVFPVIGAFPFTGRMPTVLVLTLIFGFAIAAVSYALVESPCREALRRWERRNEPISVGELQADAIAP

SEQ ID NO: 14 - DNA, 1221 bp, Mycobacterium tuberculosis
atgggcccggcggacgaatcgggtgcaccgattcgcccgcaaacacctcacaggcacactgtgttggtgaccaacggccaggtggtgggtgggacccgtggctttctgcccgccgtcgagggaatgcgcgcatgcgcggccgtcggcgtcgtggtcactcacgtcgcgttccagaccgggcactctagcggtgtgggcgggcggctgttcggccgcttcgatctggcggtggcggtgttcttcgccgtgtcgggattcttgttgtggcgcggacacgccgcagcggcgcgagatctgcggtcacacccgcgaaccggtccgtatctgcgatcgcgggtggcgcgcatcatgccggcctatgtggtggcggtggtcgtcatcctgtccctgctgcccgacgcggatcatgccagcctgaccgtgtggctggccaacctgacgctcacccagatctatgtgccgctgaccctgaccggcggcctgacccagatgtggagcctgtccgtggaggtcgccttctatgcggcgctgccggtcttagcgttgctgggccgccgaattccggtcggtgcccgagtgccggcgatcgcggcgctggcggcgctcagctgggcgtggggctggctcccgttggacgccgggtcggggatcaacccgttgacctggccgccggcgttcttctcgtggttcgccgcgggaatgttgctggcggagtgggcctacagcccggtcgggttgccgcatcggtgggcgcgccgccgcgtggcgatggcggttaccgcgctgctgggttacctggtggcggcctcgccgttggcgggtccggagggcctggttccgggcacggcggcacaattcgcggtgaagaccgcgatgggctcgctggtagcgttcgcgctggtggcgccgctggtgctggaccggcccgacacgtcgcaccggctgctgggcagccccgcgatggtgaccctgggccgttggtcctatggcctgttcatctggcatctggccgcgctggccatggtgtttcccgtgatcggagcgttcccgtttaccgggcgaatgccgacggtgctggtgttgacgctgatcttcggtttcgcgatcgccgcggtcagctacgccctggtcgagtcgccctgccgggaagcgttgcgccgctgggagcgccgcaacgaacccatatcggtcggcgaacttcaggcggacgcgattgcaccc

SEQ ID NO: 15 - protein, 381 aa, Mycobacterium tuberculosis
MAQAHSAPLTGYRIAVTSARRAEELCALLRRQGAEVCSAPAIKMIALPDDDELQNNTEALIADPPDILVAHTGIGFRGWLAAAEGWGLANELLESLSSARIISRGPKATGALRAAGLREEWSPDSESSHEVLEYLLESGVSRTRIAVQLHGAADSWDPFPEFLGGLRFAGAQVVPIRVYRWKPAPLGGVFDHLVTGIARRQFDAVTFTSAPAAAAVLERSRELDIEDQLLAALRTDVHAMCVGPVTSRPLIRKGVPTSAPERMRLGALARHIAEELPLLGSCTFKAAGHVIEIRGTSVLVDDSVKPLSPSGMAILRALVHRPGGVVSRGDLLRVLPGDGSDTHAVDTAVLRLRTALGDKNIVATVVKRGYRLAVDSRHDDV

SEQ ID NO: 16 - DNA, 1143 bp, Mycobacterium tuberculosis
atggcccaggcacactcggcgccactgaccggctaccggatcgcggtgacatccgctcgccgcgccgaagagctgtgcgcattgcttcgccgccagggcgccgaggtctgtagtgccccagcgatcaagatgatcgcgcttcccgacgacgatgaactgcagaacaacaccgaggcgttgatcgccgacccgcctgacattctggtcgcccacaccggcatcggatttcgcggctggttggccgcggccgaggggtgggggctggccaacgagctcctggaatcgttgtcgtcggcccggatcatctcccgcggaccaaaggcaactggtgcgctgcgtgccgccggcctgcgtgaagagtggtcccccgactctgaatcgtcgcatgaagtgctggaatatctgctcgaatcgggggtgtcccgtacgcgtattgccgtccagctgcacggtgccgccgacagctgggacccgtttccggaatttctgggcgggttacgtttcgccggcgcgcaagtggtgccgatccgggtttaccggtggaagccggcgccactaggcggcgtgttcgaccatttagtcaccgggatcgcgcgacgacaattcgacgcggtcaccttcacgtcggcacctgccgcagccgcggtgctagaacgcagccgtgaattggatatcgaggaccaactgttggctgcgctgcgtaccgacgtgcacgcgatgtgtgtcggcccggtaacttcgcggccgttgatccgaaagggcgtcccgacgtcggctcccgagcgaatgcggttgggagccttagcccgccacattgccgaggagctgccgctgctgggttcgtgcacgttcaaagcagccggccacgtgatcgagatccgtggaacctctgtgctggtggatgattcggtgaagccactatcgccgtccggaatggcgattttgcgcgcgttggtacatcgccccggcggcgtcgtctctcgtggcgacttgctacgcgtcctacccggcgacggcagcgacacccacgccgtggacaccgccgtcctgcggctacgaacggctctgggcgacaagaacatcgtggcaacagtggtgaaacgtggctaccgtctcgccgttgacagccggcacgatgacgta

SEQ ID NO: 17 - protein, 409 aa, Mycobacterium tuberculosis
MSQSRYAGLSRSELAVLLPELLLIGQLIDRSGMAWCIQAFGRQEMLQIAIEEWAGASPIYTKRMQKALNFEGDDVPTIFKGLQLDIGAPPQFMDFRFTLHDRWHGEFHLDHCGALLDVEPMGDDYVVGMCHTIEDPTFDATAIATNPRAQVRPIHRPPRKPADRHPHCAWTVIIDESYPEAEGIPALDAVRETKAATWELDNVDASDDGLVDYSGPLVSDLDFGAFSHSALVRMADEVCLQMHLLNLSFAIAVRKRAKADAQLAISVNTRQLIGVAGLGAERIHRAMALPGGIEGALGVLELHPLLNPAGYVLAETSPDRLVVHNSPAHADGAWISLCTPASVQPLQAIATAVDPHLKVRISGTDTDWTAELIEADAPASELPEVLVAKVSRGSVFQFEPRRSLPLTVK

SEQ ID NO: 18 - DNA, 1227 bp, Mycobacterium tuberculosis
atgagccaatcccggtacgcggggttgtcccgcagcgagctggcagttctgttacccgagctgttgttgatcggccagctgatcgaccgatcgggcatggcctggtgtatacaggcattcggccgccaggagatgctgcagatcgccatcgaggagtgggcgggcgccagcccgatctacaccaagcgcatgcaaaaggcgctgaacttcgagggcgacgacgtgcccaccatcttcaaggggctacagctcgacatcggcgcgccgccgcaattcatggacttccgtttcaccctgcacgaccgctggcacggcgagtttcacctcgaccactgcggtgcgctgctcgacgtggagccgatgggcgacgactacgtcgtcggcatgtgccacaccatcgaagatccgacgttcgacgccaccgcgatcgcgaccaacccgcgcgcgcaggtgcgccccatccaccggccgccccgcaagccggccgaccggcatccgcactgtgcgtggaccgtcatcatcgacgagtcctatcccgaggctgagggtattccggcgctggacgcggtccgtgaaaccaaagctgccacctgggaattagacaacgtcgatgcgtctgacgacgggctggtggactattcgggtccgctggtgtccgacctggacttcggggcgttctcgcattccgcactggtgcggatggccgatgaggtctgcctgcaaatgcacctgctgaatctgtcgttcgccattgccgtgcggaaacgggccaaagccgatgctcaactggccatttcggtgaacacccgccagttgatcggagtggccgggctgggcgcagaacgcattcaccgtgcgatggctttacccggcggaatcgaaggcgcgttaggtgtgctggagctacacccgctgctcaacccggccggttacgtgctggccgaaacgtcgccggaccgtctggtggtgcacaactcgccagcccacgccgacggcgcctggatttcgttgtgcacaccggcatccgtgcagccgttgcaggccatcgccaccgctgtagacccgcatctgaaggttcggatcagcgggacggacaccgactggaccgcggaactcatcgaggccgatgccccagcgagcgaactgccggaggtgttggtagccaaggtcagtcgcggatcggtcttccagttcgagccgaggcgctcactgccgttgaccgtgaaa

SEQ ID NO: 19 - protein, 443 aa, Mycobacterium tuberculosis
VRCSVFGTGYLGATHAVGMAQLGHEVVGVDIDPGKVAKLAGGDIPFYEPGLRKLLTDNLAAGRLRFTTDYDMAADFADVHFLGVGTPQKIGEYGADLRHVHAVIDALVPRLVRASILVGKSTVPVGTAAELGHRAGALAPRGVDVEIAWNPEFLREGFAVHDTLNPDRIVLGVQDDSTRAEVAVRELYAPLLAAGVPFLVTDLQTAELVKVSANAFLATKISFINAISEVCEAAGADVSQLADALGYDPRIGRQCLNAGLGFGGGCLPKDIRAFMARAGELGADQALTFLREVDSINMRRRTKMVELATTACGGSLLGANIAVLGAAFKPESDDVRDSPALNVAGQLQLNGATVHVYDPKALDNAHRLFPTLNYAVSVAEACERADAVLVLTEWREFIDLEPADLANRVRARVIVDGRNCLDVTRWRRAGWRVFRLGVPRLGH

SEQ ID NO: 20 - DNA, 1329 bp, Mycobacterium tuberculosis
gtgcgatgcagcgtcttcggcactgggtatctgggtgccacccacgccgtcggtatggcgcaactgggacacgaggtcgtcggggtcgatatcgatcccggtaaggtcgccaagctcgccgggggtgacattccgttctacgaacccggcctgcgaaagctgttgactgataacctggctgccggccgcttgcggttcaccaccgactacgacatggcggccgatttcgccgacgtgcatttcctgggggtcggcacgccgcaaaagataggcgaatatggcgccgacctgcggcatgtccacgccgtcatcgatgcgctggtgccgcgtctggtcagggcgtcgattctggtcggcaagtcgacagtcccagtgggcaccgcagccgaactgggacatcgggccggtgcactggcaccccggggagtcgacgtggaaattgcctggaatccggaattcctgcgcgagggcttcgcggtgcacgacaccctcaaccccgaccgtatcgtccttggggtacaagatgattcgacgcgcgccgaggtagccgtccgcgagctgtacgcgccgctgctggcagcgggcgtgccgtttctggtgaccgatctgcagaccgcggagttggtcaaggtatccgccaatgcctttctggcgaccaagatttcgtttatcaatgcgatctccgaagtgtgcgaggcggcgggtgccgacgttagccagctggccgatgcgctcggatacgacccgcggatcggacgccaatgcctcaacgcgggcttgggtttcggcggcggctgcttgcccaaggacatccgcgctttcatggcccgcgccggcgaactgggagccgaccaggcgttgacgttcctgcgtgaagtggacagcatcaacatgcgccggcgcaccaagatggtggaactggccaccaccgcatgcggtggctcgttgctgggcgccaatattgcggtgctcggcgcggcgttcaaacccgaatccgatgacgtgcgcgattcgcccgccctcaatgtggcgggccagctgcagctcaacggcgccacggtccacgtgtacgatccaaaggccttggacaacgcccaccgactgttccctaccttgaactatgcggtttcggttgcggaggcctgcgagcgcgcggacgccgtgttggtgcttaccgaatggcgggagttcatcgatctcgaacccgctgatctagccaaccgggtgcgggcccgggtgatcgtggacggccgcaactgcctcgacgtgacccgctggcggcgggcaggctggcgggtgttccggctgggagtgccgcgattagggcac

SEQ ID NO: 21 - protein, 74 aa, Mycobacterium tuberculosis
VGPKGSLRLVKRQPELLVAQHEHWQDTYRAHPVLYGTRPSEPGVYAAEVFNADGVQRVLELAAGHGRDTLYFAG

SEQ ID NO: 22 - DNA, 222 bp, Mycobacterium tuberculosis
gtggggccgaagggaagtctacgtttggtgaagcggcagccagaactgctcgttgcccagcatgaacactggcaggacacctaccgagcgcatccggtgctgtacggaacccgcccgtcagagccgggggtatatgccgccgaggtgttcaatgccgacggcgtgcagcgggtgctggagttggcggccggtcatgggcgtgacaccctgtatttcgctggc

SEQ ID NO: 23 - protein, 419 aa, Mycobacterium tuberculosis
VIDGWTEEQHEPTVRHERPAAPQDVRRVMLLGSAEPSRELAIALQGLGAEVIAVDGYVGAPAHRIADQSVVVTMTDAEELTAVIRRLQPDFLVTVTAAVSVDALDAVEQADGECTELVPNARAVRCTADREGLRRLAADQLGLPTAPFWFVGSLGELQAVAVHAGFPLLVSPVAGVAGQGSSVVAGPNEVEPAWQRAAGHQVQPQTGGVSPRVCAESVVEIEFLVTMIVVCSQGPNGPLIEFCAPIGHRDADAGELESWQPQKLSTAALDAAKSIAARIVKALGGRGVFGVELMINGDEVYFADVTVCPAGSAWVTVRSQRLSVFELQARAILGLAVDTLMISPGAARVINPDHTAGRAAVGAAPPADALTGALGVPESDVVIFGRGLGVALATAPEVAIARERAREVASRLNVPDSRE

SEQ ID NO: 24 - DNA, 1257 bp, Mycobacterium tuberculosis
gtgatcgacggctggacggaagaacagcacgaacccaccgttaggcatgagcgcccagcagctccccaagacgttcggcgggtgatgttgctgggttcggccgaacccagccgggagctggcgatcgcgttgcagggcttgggcgcggaggtgatcgccgtcgacggctatgtcggcgcgcctgcccaccggatagccgaccagtcggtggtggtcaccatgaccgatgctgaagagctgacggcggtgatccggcggctgcaaccggatttcttggtgacggtcaccgccgcggtgtctgtggatgctctcgatgccgtcgagcaagccgacggcgagtgcactgagctggtgccgaacgcccgtgccgtccggtgcacggccgaccgggagggcctgcgccggctggccgccgatcagctcggcctgcccacagccccgttctggttcgtcggatcccttggcgaacttcaagcggtggccgtccatgctgggtttccgttgctggtgagcccggtggcaggggtggctggccagggtagctcggtggtcgccgggcccaacgaggtcgagcccgcctggcagcgcgcggcaggccatcaagtacagccgcagactgggggagtgagccctcgggtgtgcgccgagtcggtggtcgagatcgagtttttggtcaccatgatcgttgtgtgcagtcagggcccgaacgggccgctcatcgagttctgtgcacctatcggtcatcgcgacgccgatgccggtgagttggaatcctggcaaccgcagaagctgagcacggcggcgctggacgcggccaagtcgatcgccgcgcgcatcgtcaaggcgctcgggggacgcggggttttcggcgtcgaattgatgatcaacggcgatgaggtgtatttcgccgatgtcaccgtgtgtcctgccgggagtgcctgggtcaccgtgcgcagccagcggctttcggtgttcgaactgcaggcccgggcgatcctgggtctggcggtggacaccctgatgatctcgccgggtgccgcgcgggtgatcaacccggaccacacggcaggccgggcagcggtcggcgccgcaccacctgccgatgcgctgaccggtgcgctcggtgtgccggaaagcgacgtcgtgatattcggccgcgggcttggggtggcgctggccaccgcacccgaggtggcaatcgcccgcgaacgcgcccgcgaagttgcatctcggctaaatgtgccagactcacgcgag

SEQ ID NO: 25 - protein, 140 aa, Mycobacterium tuberculosis
VSYAGDITPLQAWEMLSDNPRAVLVDVRCEAEWRFVGVPDLSSLGREVVYVEWATSDGTHNDNFLAELRDRIPADADQHERPVIFLCRSGNRSIGAAEVATEAGITPAYNVLDGFEGHLDAEGHRGATGWRAVGLPWRQG

SEQ ID NO: 26 - DNA, 420 bp, Mycobacterium tuberculosis
gtgagctacgccggagatatcacgccacttcaggcctgggagatgctcagcgataatccgcgggcggtcctggtcgacgtgcgctgcgaggcggaatggcgcttcgtcggtgtgcccgacttgtcgagccttggtcgtgaagtggtctatgtcgaatgggcgacgtccgacgggacgcacaacgacaacttcctcgccgagttgcgggaccgcatcccggcggacgctgatcagcacgagcggcccgttattttcttgtgtcgctccggtaaccgctccatcggcgcggccgaggtcgcgaccgaggcgggcatcacgccggcctataacgtgctggacggcttcgaagggcatctcgacgctgagggtcatcgaggcgcaacgggctggcgggcggtgggactgccgtggagacaggga

SEQ ID NO: 27 - protein, 134 aa, Mycobacterium tuberculosis
MDWMPLGDYETFRHWSGKPRAWGPQESGWRAWFGGKIVDGLCEVLDEHLAVRRRGVPAAIGCVPWLSSEAVAETLLALSVFCVVIDKGTSFPSRLRNPDKGFPNVALLRLRDMAPSEHGSRCSSARGRLCLSMS

SEQ ID NO: 28 - DNA, 402 bp, Mycobacterium tuberculosis
atggattggatgccgctcggcgactacgagactttccggcattggtcggggaagccccgcgcatgggggccgcaagagtcggggtggcgcgcgtggttcggcgggaagatagtcgatgggctctgcgaggtactcgacgagcacctcgcggtgcggcgtcgtggtgttccagccgcgatcggctgcgtgccctggctgagtagcgaggcggtcgccgagacgctgctcgcattgagcgtcttttgcgtggtgatcgacaagggaacctcgttcccgtcgcgactgcgtaaccctgacaaagggtttcccaacgtcgccctattgcggcttcgcgacatggcgccctccgagcatggctcacgctgctcctcggcccgtggtcgtctatgcctgagcatgagc

SEQ ID NO: 29 - protein, 340 aa, Mycobacterium tuberculosis
VPACPAPARAGTARSSPGASWIARLLRAPVRRARRRAQAGLPGSCARRCGALVAGPRLARMRIALAQIRSGTDPAANLQLVGKYAGEAATAGAQLVVFPEATMCRLGVPLRQVAEPVDGPWANGVRRIATEAGITVIAGMFTPTGDGRVTNTLIAAGPGTPNQPDAHYHKIHLYDAFGFTESRTVAPGREPVVVVVDGVRVGLTVCYDIRFPALYTELARRGAQLIAVCASWGSGPGKLEQWTLLARARALDSMSYVAAAGQADPGDARTGVGASSAAPTGVGGSLVASPLGEVVVSAGTQPQLLVADIDVDNVAAARDRIAVLRNQTDFVQIDKAQSRG

SEQ ID NO: 30 - DNA, 1020 bp, Mycobacterium tuberculosis
gtgccagcttgcccggctcctgcgcgcgccggtacggcgcgctcgtcgccgggcgcaagctggattgcccggctcctgcgcgcgccggtgcggcgcgctcgtcgccgggcgcaagctggattgcccggctcctgcgcgcgccggtgcggcgcgctcgtcgccgggcctaggctggcgcgcatgcgaatcgcgttggcgcaaatccgcagcggtaccgaccccgccgccaatctgcaactggtcggcaagtacgccggcgaagccgccaccgcgggcgcacagctggtggtgtttcctgaggcgaccatgtgccggctcggtgtcccgctgcggcaggtcgccgagcccgtcgacggaccctgggcaaacggagtccgacggatcgcgaccgaggcgggcatcaccgtgatcgccggcatgttcaccccgaccggcgacgggcgggtaacaaacacgctgatcgcagccggcccgggcacgcccaatcagccggacgcgcactaccacaagatccacctctatgacgcgttcggcttcaccgagtcacgtaccgtcgcacccgggcgcgaaccggtggtagtcgtggtcgacggcgtgcgggtgggtttgaccgtttgctacgacattcgctttcccgccctttataccgagctggcgcggcgcggggcccaactgatcgcggtctgtgcatcctggggttccggtccgggcaaactcgaacagtggacgttgctggcccgcgcccgggcgctagactccatgagttacgtcgccgcggccggccaagcagacccaggtgatgcccgcaccggcgtgggggcgagctcggctgcaccgaccggggtaggcggcagcctggtggcctcgccgctaggcgaggtggtggtgtcagctggcacccagccgcaactgctggtcgccgacatcgatgtcgacaatgtggccgcggctcgcgaccgcattgcggtgctacgcaaccagacagacttcgttcagatcgataaggcacaatcgcgtggg

SEQ ID NO: 31 - protein, 329 aa, Mycobacterium tuberculosis
VGESTTQPAGGAAVDDETRSAALPRWRGAAGRLEVWYATLSDPLTRTGLWVHCETVAPTTGGPYAHGWVTWFPPDAPPGTERFGPQPAQPAAGPAWFDIAGVRMAPAELTGRTRSLAWELSWKDTAAPLWTFPRVAWERELLPGAQVVIAPTAVFAGSLAVGETTHRVDSWRGSVAHIYGHGNAKRWGWIHADLGDGDVLEVVTAVSHKPGLRRLAPLAFVRFRIDGKDWPASPLPSLRMRTTLGVRHWQLEGRIGGREALIRVDQPPERCVSLGYTDPDGAKAVCTNTEQADIHIELGGRHWSVLGTGHAEVGLRGTAAPAIKEGTPA

SEQ ID NO: 32 - DNA, 987 bp, Mycobacterium tuberculosis
gtgggcgaatcgacaactcagccagcaggaggtgccgcagtggacgatgaaacgcggtcggcggccttgccgcggtggcgcggtgcagccgggcgcctggaagtctggtatgcgactctgtcggatccactgacgcgtaccggcctatgggtgcactgtgagacggtggccccgacgaccggcgggccctacgcgcacggctgggtgacctggtttccaccggatgccccgccgggcaccgagcgcttcggcccccagcccgcccaacccgcggccggccccgcctggttcgacatcgccggtgtacgaatggcgccagcggagctgaccggacgtacccgatcactcgcatgggagctgtcctggaaggacaccgcggcgccactgtggacgtttcctcgcgtggcctgggagcgcgagttgctgcccggcgcccaagtggtgatcgcacccaccgccgtcttcgctggctccttggccgtcggcgaaaccacccaccgcgtcgacagctggcgcggcagtgtggcccacatctacggacatggcaatgccaagcggtggggatggatccatgccgatctcggcgacggcgacgtcctagaggtggtgaccgcggtatcacacaagccgggcctacgcaggctcgcgccgctagcgttcgttcgcttccgcatcgacggaaaggattggcccgcaagtcctttaccgtcgctgcgaatgcggacaacgctcggcgtgcggcactggcaactggaaggacgcatcggcggccgggaggcgctaatccgggtagaccagccgccggagcggtgcgtaagcctgggatacaccgatcccgacggggccaaggcggtgtgcaccaacaccgagcaggccgacatccacatcgagctcggcggccggcactggtcggtgctgggcaccggacacgccgaagtcggcctgcggggaaccgcggcaccggctatcaaggaagggacgccagca

SEQ ID NO: 33 - protein, 292 aa, Mycobacterium tuberculosis
VASFAQWVSGARPRTLPNAIAPVVAGTGAAAWLHAAVWWKALLALAVAVALVIGVNYANDYSDGIRGTDDDRVGPVRLVGSRLATPRSVLTAAMTSLALGALAGLVLALLSAPWLIAVGAICIAGAWLYTGGSKPYGYAGFGELAVFVFFGPVAVLGTQYTQALRVDWVGLAQAVATGALSCSVLVANNLRDIPTDARADKITLAVRLGDARTRMLYQGLLAVAGVLTFVLMLATPWCVVGLVAAPLALRAAGPVRSGRGGRELIPVLRDTGLAMLVWALAVAGALAFGQLS

SEQ ID NO: 34 - DNA, 876 bp, Mycobacterium tuberculosis
gtggccagtttcgcacagtgggtctccggcgcgcggccccgaacgctgccgaacgcgatcgcgccagtggttgccggcaccggcgccgcggcctggctgcacgcggccgtgtggtggaaagcgctgttggcactggctgttgcggtggcgctggtcattggggtcaattacgccaatgactactccgacggcatccgcggcaccgatgacgacagggtgggtccggtgcggttggtgggctcgcggctggcgaccccgcgctcggtgctgaccgctgccatgacgagcctggcgctcggtgcgctggccgggctggttttggcgctgctcagcgcgccgtggctgattgcggtgggtgcgatctgcatcgccggggcctggctctacaccggcgggtcaaaaccctacggctatgcgggcttcggcgaactggcggtgtttgtgttcttcgggccggtcgccgtgctcggtacccagtacacgcaggcattgcgggtggactgggtggggctggcacaggcggtagcaacgggtgcgttgtcgtgctcggtgctggtggccaacaacctgcgcgacatccccaccgacgcgcgggccgacaagatcacgctggcggtgcggctgggagacgcccggacccggatgctttaccagggcctgctggcggtcgccggggtgctgacgttcgtgctaatgctggccacgccgtggtgtgtggtgggcttggtggccgcgcctttggcgctgcgcgctgccggaccggtgcgatccgggcgcggcgggcgcgagctgatcccggtactgcgtgacactgggctggccatgctggtgtgggcgttggcggtggcgggggcattggcgtttggtcagttgagc

SEQ ID NO: 35 - protein, 378 aa, Mycobacterium tuberculosis
VCGVRVAIVAESFLPQVNGVSNSVVKVLEHLRRTGHEALVIAPDTPPGEDRAERLHDGVRVHRVPSRMFPKVTTLPLGVPTFRMLRALRGFDPDVVHLASPALLGYGGLHAARRLGVPTVAVYQTDVPGFASSYGIPMTARAAWAWFRHLHRLADRTLAPSTATMESLIAQGIPRVHRWARGVDVQRFAPSARNEVLRRRWSPDGKPIVGFVGRLAPEKHVDRLTGLAASGAVRLVIVGDGIDRARLQSAMPTAVFTGARYGKELAEAYASMDVFVHSGEHETFCQVVQEALASGLPVIAPDAGGPRDLITPHRTGLLLPVGEFEHRLPDAVAHLVHERQRYALAARRSVLGRSWPVVCDELLGHYEAVRGRRTTQAA

SEQ ID NO: 36 - DNA, 1134 bp, Mycobacterium tuberculosis
gtgtgtggcgtgcgcgttgcgatcgtcgccgagtcgttcctcccgcaggtgaacggcgtcagcaactcggtggtcaaggtactcgaacatctgcgtcgaaccggtcatgaagccctggtgatcgcgcccgacacgccgccaggtgaagaccgcgccgagcgacttcacgacggtgtccgggtgcaccgggtgccgtcgcggatgttcccaaaggtgaccacgttgccgctcggcgtgcccaccttccgaatgctgagagcgctgcgcggattcgatccggatgtcgtgcatctggcgtcgccggcgctgcttggctacggtggactccatgccgctcggcggctaggggtgcccacggtcgcggtctaccaaaccgatgttccgggtttcgcgtccagctacggcattccgatgacagcacgggcggcgtgggcatggttccgccacttgcatcgcctggctgaccgcactctggcgccgtccacagcgacaatggaatcccttattgcccagggcattccgcgagtacaccggtgggcacgcggggtggacgtgcaacgtttcgcgccgtcggcgcgaaacgaggtgttgaggcgacggtggtcaccggacggcaaacccatcgtcggctttgtgggtcggcttgctccggagaagcatgtcgaccggctcacgggtctggcggcctccggcgccgtgcggctggtgatcgtcggcgacggcatcgaccgggcaagattgcaatcagcaatgcccacagcggttttcaccggagcacggtatggcaaagagctcgccgaggcgtatgccagcatggacgtcttcgtacattccggtgagcacgagacgttctgccaagtcgtgcaggaagcgctggcgtcggggctaccggtgatcgctccggacgccggcggaccgcgtgatctgataaccccgcaccgcaccgggctgctgttgccggtcggcgagttcgagcaccggcttcctgacgccgtcgcccacctggtgcacgaacgccagcgctacgcgctggccgcccggcgcagtgtgctgggccgcagttggccggtggtctgcgatgagctgctcggccactacgaggcggtgcgaggtcggcgcacgacccaggccgcg

SEQ ID NO: 37 - protein, 330 aa, Mycobacterium tuberculosis
LPAIPFQGEARAGRRPGRPRRCPAGVVRCRPRSMGHVRPGFSPRLGSHRTLRPRWPPYAAASRGLTSGTSRWGWPRLGFGVVTAPTRWTLADGRELLFFSLPGPRTSGTAAERVARHAQAQTFAGDIRQRAIQLVVSEQEVASKITAATAGIATTTFPETPSIDDTIIGNDNRDTGVRLVDVKQDGGTSPPPPFAPWDTPDGTPPPGTGLSPTLQQMILGGDPANLTGQGLADNVQRFVQSLPANDPNTAWLRGQVADLQAHVADIEYARTHCSTNDWIDRTAQFASGAIVFSIGVLTAETGAGVVAAAAGGVGAATAGVSLLQCLVGSK

SEQ ID NO: 38 - DNA, 990 bp, Mycobacterium tuberculosis
ttgccggccattccgtttcaaggcgaagcgcgcgcaggacggcgtccgggtcggccacgccgctgtccagcaggcgtcgtgcgatgtcgtcctcgctcaatgggccatgttcggccaggattctcgccacggcttgggtcgcatcgaacgcttcggccacggtggccaccttatgccgcggccagccgaggcttgacgtcgggcaccagccgatggggctggcctcgcctagggttcggcgttgtgacggcgccgacgcggtggaccctggccgacggacgtgagctgctgttcttttcgctgcccgggccccgcaccagcggcaccgccgcagaacgggtggctcgccacgctcaagcgcaaacgttcgccggcgatatccgccagcgcgccatacagctggtcgtgtccgaacaagaagtggcaagcaaaatcaccgccgctaccgccggaatcgccaccaccaccttcccggaaacacccagcatcgacgacaccatcatcggcaacgacaaccgcgacactggggtccggttggtcgacgtcaaacaagatggcggcactagtcccccgcccccatttgcgccgtgggacacccctgatggaacaccgccgccgggcactggcctaagccctacgctgcagcagatgatcctcggcggtgatccagctaatctgaccggccagggtcttgcggacaacgtgcaacggttcgtacagtcgctgcccgcaaacgaccccaacacagcgtggttgcgcggtcaggttgcggatctgcaggcgcacgtcgccgatattgagtacgcccgcacccattgcagcaccaacgactggatcgaccggaccgcccagttcgcctcgggcgccatagtcttcagcatcggcgtgttgaccgcagagaccggggcgggggtcgtggctgccgcggccggtggtgtcggcgcggccacggcgggcgtgagtcttctacaatgcctggtggggagcaag

SEQ ID NO: 39 - protein, 354 aa, Mycobacterium tuberculosis
MAGDRGADPGPANVTPGADDHAQHASPTVLCPQGHVNAWDYRFCERCGSPIGVVPWPSEESGTRQTAPARSFVPLVVLAATLLVVAVVVTAVGYAVTRPARNDREEPSSARGAATTGVPFAQAEAASCPDDPVLEAESIDLTSDGLAVSAAFMSACAGGDVESNSALEVTVADGRRDVAAGSFDFSADPLRIEPGVPARRTLVFPPGMYWRTPDMLSGAPALAATRKGRSDRSAARGGSARTTMVAAASAAPAYGSINAVAGAVLVELRDSDFPYVRVGIANRWVPQVSSKRVGLVAAGKTWTSADILRDHLALRQRFGGARLVWSGHWTTFSGPDFWVTVVGPAQPTAAEANR

SEQ ID NO: 40 - DNA, 1062 bp, Mycobacterium tuberculosis
atggcaggcgatcgaggcgctgaccccggtccggcgaatgtgactccgggtgcggatgaccatgcacagcatgcgtcgccgacggtgctatgtccccagggtcacgtgaacgcatgggactacaggttctgtgagcggtgcggctcgccgatcggcgtggtgccctggccgtcggaggaatcaggcacacgccagacggcgcccgcgcgatccttcgtccccctcgtcgtcctcgcggcgacgctgctcgtggtcgccgtcgtcgtgacggccgtcggctacgcggtgacgcgaccggctcgcaacgaccgtgaggagcccagttccgcgcggggcgccgccacgacgggtgtgccgttcgcacaggccgaggccgcgagttgcccggacgatccggtgcttgaagcggagtcgatcgacctgacgtccgacgggcttgcggtgagtgccgcgttcatgtcggcatgcgccggcggcgatgtcgagtcgaactcggcgctcgaggtcaccgtcgccgacggacggcgcgacgtggcggccggaagcttcgacttctcggcagatccgctgaggatcgagcccggcgtgcccgcccgtcgaaccctggtctttccgcccggaatgtattggcgaacgcccgacatgttgtccggcgcaccggcattggcggccacacggaagggcaggtccgatcgttcggccgcacgaggcggatcggcacggacgaccatggtcgcggccgcgtccgcggcaccggcttacggcagcatcaacgccgttgccggggcggtgctggtggagctacgtgactcggacttcccctacgtgcgagtcggtatcgccaatcgctgggtgccgcaggtgagttcgaagcgcgtcggcctggtcgccgcggggaaaacgtggacgagcgccgatattcttcgcgatcacctggccctgcggcagcggttcgggggcgcccgcctggtgtggtcggggcactggaccaccttcagcggacccgatttctgggtgacggtggttgggccggcgcagcccaccgcagctgaggccaatcgc

SEQ ID NO: 41 - protein, 341 aa, Mycobacterium tuberculosis
MTVSRSSSAPSLARRARRCTGSDDAAMSFCVYCGAELADPTRCGACGAYKIGSTWHRTTTPTVGAATTATGWRPDPTGRHEGRYFVAGQPTDLVREGDAEAVDPLGQQQLDQSGAVGVSPSAVSGWVRSGHRRLWWALAGVVAFLGLVGAGVVGTLFLNRDRESIDDKYLAALRRSGLTGEFNSDANAIARGKQVCRQLQDGGEQQGMPVDQVAVQYYCPQFSDGFHILETITVTGSFTLKDESPNVYAPAITVSGSGCSGSAGYADIDRGTQVTVKNGQGDILATAFLQAGQGGRFLCTFPFSFEITEGEDRYVVSVSRRGEMSYSFADLKANGLSLVLG

SEQ ID NO: 42 - DNA, 1023 bp, Mycobacterium tuberculosis
atgactgtttcgcgaagttcatcagcaccctcgttggcgcgaagggcacgacggtgtaccggaagtgacgacgctgccatgagtttctgcgtgtattgcggtgccgagcttgccgacccgaccaggtgcggggcgtgcggcgcatacaagattggttcaacctggcatcggaccacgacgccgacggtcggcgccgcgacgacggcaacgggatggcgacccgatcccaccggtcgccacgagggacgctacttcgtcgccgggcagccgaccgacctcgttcgcgagggcgacgccgaagccgttgacccacttggtcagcagcagctggatcagtcaggtgccgttggtgtttcgccgtcagcggtgtcggggtgggtgcgttctgggcaccgtcgactgtggtgggcgcttgcgggcgtggtggcgtttctcgggctggtgggagccggtgtcgtcgggacgctgttcctgaatcgagaccgggagtccatcgacgacaagtacctcgccgccttgaggcggtccggactcaccggtgagttcaactccgacgcgaacgccatcgcccgcggcaagcaggtgtgccgccagttgcaagacggtggcgaacagcaggggatgccggtcgatcaggtcgccgtgcaatactactgcccgcagttcagcgatggcttccatatcctggaaaccataactgtcactggaagtttcaccctcaaggatgaatcgccaaacgtgtacgcaccggcgatcaccgtgtcgggctccgggtgctcagggtcagccggctacgccgacatcgaccggggaacgcaggtgacggtgaaaaacggtcagggggacatcctggccacggccttcctgcaggcgggtcagggcggccgattcttgtgcaccttccctttctcgtttgaaatcaccgagggcgaagaccgctacgtcgtgtcggtcagtcgtcgaggcgaaatgagttactcgttcgccgatctgaaggccaatgggctatcgctcgtcttgggc

SEQ ID NO: 43 - protein, 479 aa, Mycobacterium tuberculosis
VTAAVRHSDVLVVGAGSAGSVVAERLSMDSSCVVTVLEAGPGLADPGLLAQTANGLQLPIGAGSPLVERYRTRLTDRPVRHLPIVRGATVGGSGAINGGYFCRGLPSDFDRASIPGWAWSDVLEHFRAIETDLDFETPVHGRSGPIPVRRTHEMTGITESFMAAAEDAGFAWIADLNDVGPEMPSGVGAVPLNIVNGVRTSSAVGYLMPALGRPNLTLLARTRAVRLRFSATTAVGVDAIGPGGPVSLSADRIVLCAGAIQSAHLLMLSGVGEEEVLRSAGVKVLMALPVGMGCSDHPEWVMPTNWAVAVDRPVLEVLLSTHDGIEIRPYTGGFVAMTGDGTAGHRDWPHIGVALMQPRARGRITLVSSDPQIPVRIEHRYDSEPADVAALRQGSALAHELCGAATRIGPAVWATSQHLCGSAPMGTDDDPRAVVDPRCRVRGIENLWVIDGSVLPSITSRGPHATIVMLGHRAAEFVQ

SEQ ID NO: 44 - DNA, 1437 bp, Mycobacterium tuberculosis
gtgactgcggcggtccggcatagcgatgtgctggtcgtcggtgctggaagtgctggatcggttgttgccgagcgtctttccatggactcgagctgtgtggtgaccgtgcttgaggctggccccgggctggccgatccggggttgctggctcagacggccaatgggttgcaactgccgatcggagctggcagccctctggttgagcgttatcggacgcggctcaccgatcgaccggttcgccacttgccgatcgtgcggggtgcgacggtcggcggttccggcgcaatcaacggcggctatttctgccgcggactgcccagcgatttcgaccgtgcctcgataccaggctgggcatggtctgacgttctggagcacttccgggctatcgagacagatctggatttcgagacgcctgtgcatggccgtagtggccccatcccagttcgccgcacacacgaaatgactggcatcactgaaagtttcatggctgccgcagaggacgcagggttcgcttggatcgctgacctcaacgatgttgggccggaaatgccttcgggtgtaggcgcggtcccgctcaacatcgttaacggcgtacgcaccagctcggcggtcggctatctgatgcccgcgctgggacggccgaatctgacactgctggcccggacgcgggcggtgcggttgcgcttttccgccaccaccgcggtgggtgtcgacgcgatcggcccaggaggcccggtaagcctgagcgctgaccgaatcgtattgtgcgccggagcgattcagtcagctcatctgttgatgctctcgggcgtcggcgaggaggaggtgttgcgatccgccggtgtgaaggtgcttatggcgttgccggttggcatgggctgcagtgaccacccggaatgggtgatgccgaccaactgggcggtggctgtcgatcggccggtgttagaggtgctgctgagcactcatgacggcatcgaaataaggccgtacacaggcggcttcgttgcgatgaccggcgacggtacagccgggcatcgcgattggccgcatatcggggtggcgctcatgcagccgcgggcacgcggacgcatcacgttggtctcgagtgatccccagataccagtccgcatcgagcaccgatacgacagtgaacctgccgatgtcgcggccctgcgccagggtagcgcattggcccacgaattatgcggtgcggcaacgcgcatcggtccagccgtatgggcgacatcgcagcatctgtgtggtagtgccccaatgggcaccgacgatgacccacgagccgtcgtcgacccgaggtgtcgggtccgcggcatcgaaaacctatgggtgatagacggatctgtccttccgtcgatcaccagtcgcggtccacacgcaacgatcgtaatgctgggccaccgcgcggccgaatttgttcag

SEQ ID NO: 45 - protein, 203 aa, Mycobacterium tuberculosis
LGRRGNRRVHVDRVRLTGTERELRAENQSPPIFRPQNTLGDGANGLPLAVCTTTAHTCHTSHTHPSRWTPNPVPATKGVPAGLVQATFIIENLDPGNNDTPTPPTPKLRLARKPGHHRRSEYDADSVLRRKDTSRRCVQADDVRCVQLVQDPRRGRVELGGYRAELTVGRRAAVNCQRPQYGADGWPVRLGCGVGGAARGDQR

SEQ ID NO: 46 - DNA, 609 bp, Mycobacterium tuberculosis
ttgggtcgcaggggtaaccgaagggtgcacgttgaccgcgtgaggctaaccggcaccgagcgtgaactgagggcggagaatcagagccccccgattttccgcccgcagaacacgttgggcgacggcgccaacgggctgccactggccgtgtgcaccacgacggctcacacgtgccacacttcccatactcacccatcgcggtggaccccaaacccagtgccggccaccaagggcgtccccgctggattggtgcaagcaaccttcatcatcgaaaaccttgaccccggcaacaacgacacgccgaccccccctacacccaaactgcgattagcccgaaaacctgggcaccataggcgatctgaatacgatgcggattcggtgctgcggagaaaggatacatcgcgccgatgcgtccaggcggatgacgtccgatgcgtgcagctggtccaggatccgcggcgcggacgtgtcgaactcggtggttaccgcgccgagcttactgttggccgacgggcggcggtgaattgccaacgcccgcaatatggtgcggatggatggcccgttcggttgggttgcggggtaggcggcgccgcgcgaggcgatcagcgc

SEQ ID NO: 47 - protein, 250 aa, Mycobacterium tuberculosis
MTMPLRGLGPPDDTGVREVSTGDDHHYAMWDAAYVLGALSAADRREFEAHLAGCPECRGAVTELCGVPALLSQLDRDEVAAISESAPTVVASGLSPELLPSLLAAVHRRRRRTRLITWVASSAAAAVLAIGVLVGVQGHSAAPQRAAVSALPMAQVGTQLLASTVSISGEPWGTFINLRCVCLAPPYASHDTLAMVVVGRDGSQTRLATWLAEPGHTATPAGSISTPVDQIAAVQVVAADTGQVLLQRSL

SEQ ID NO: 48 - DNA, 750 bp, Mycobacterium tuberculosis
atgacgatgccgctacgaggacttggcccgcccgatgacaccggtgtgcgcgaggtgtcgacgggtgatgatcaccactacgcgatgtgggatgcagcttacgtgttgggagcattgtctgcggccgaccgccgcgaattcgaagcgcacctggccggttgccccgaatgccggggggccgtcaccgaactctgcggggtgcccgccctgctgtcccagctcgatcgtgacgaagtggccgcgattagcgaatccgccccgactgtggtggcttcggggctgtcgccggagttgttgccgtcgttgctggcggcggtgcacaggcgtcggcgccgtacccggctgatcacctgggtggcctcgtccgccgctgccgcggtgctggcgatcggtgtgctagtcggtgtgcagggccactccgcggcaccgcagcgggcggccgtgtcggcgctgccgatggcccaggtcggcacgcagctgttggcgtccacggtgtcgatcagcggcgagccttgggggacgttcatcaacctgcggtgcgtctgcctggcgccgccgtatgcttcccacgacacgctggccatggttgtggtgggtcgtgacggcagccagacacggctggcgacttggttggccgaacccggtcacaccgcgacacccgccggcagcatttcgacaccggttgaccagatcgccgccgtgcaagtggttgccgccgataccggccaggttctgctgcagcgttcgctc

SEQ ID NO: 49 - protein, 294 aa, Mycobacterium tuberculosis
MTTIAFLGLGNMGAPMSANLVGAGHVVRGFDPAPTAASGAAAHGVAVFRSAPEAVAEADVVITMLPTGEVVRRCYTDVLAAARPATLFIDSSTISVTDAREVHALAESHGMLQLDAPVSGGVKGAAAATLAFMVGGDESTLRRARPVLEPMAGKIIHCGAAGAGQAAKVCNNMVLAVQQIAIAEAFVLAEKLGLSAQSLFDVITGATGNCWAVHTNCPVPGPVPTSPANNDFKPGFSTALMNKDLGLAMDAVAATGATAPLGSHAADIYAKFAADHADLDFSAVIHTLRARADA

SEQ ID NO: 50 - DNA, 882 bp, Mycobacterium tuberculosis
atgacgaccatcgccttcctaggtttgggcaacatgggtgcgccgatgtcggcgaatctggttggtgcgggccacgtcgtgcgtggattcgacccggcacccacggcggcgtccggcgccgccgcgcacggtgtcgcggtgtttcgtagcgcgcccgaagcggtggccgaggccgacgtggtcatcaccatgctgcccaccggcgaggtggtccggcgctgctacaccgacgtgctggccgccgcgcgtccggcaacgctgttcatcgacagctccacgatctcggtcaccgatgcccgtgaggtgcacgcgctggccgaatcgcacggcatgctccaactggatgcgccggtctccggcggggtgaagggcgccgccgccgcgacgctggcattcatggtcggcggcgacgagtccacgctacggcgggcacgcccggtactagagcccatggcgggcaagatcattcactgcggcgccgccggtgccggacaggccgccaaggtgtgcaacaacatggtgctggcggtgcagcagatcgcgatcgccgaggcgttcgtgctggccgagaagctcgggctgtccgcacaatcgttgttcgacgtcatcaccggcgcgaccggcaattgctgggcggtgcacaccaattgcccggtgccgggcccggtgcccacctcaccggccaacaacgacttcaagcccgggttttcgaccgcgttgatgaacaaggacctgggcctggcgatggatgcggtggccgccaccggtgcgacggccccgctgggcagccacgccgccgacatctacgccaaattcgccgccgaccacgccgacctggacttcagcgcggtgatccacacgttgcgcgcgcgagcagacgca

SEQ ID NO: 51 - protein, 207 aa, Mycobacterium tuberculosis
MGVTAAVTPKGERRRYALVSAAAELLGEGGFEAVRHRAVARRAGLPLASTTYYFSSLDDLIARAVEHIGMIEVAQLRARVSALSRRRRGPETTAVVLVDLLVGEMSSPGLAEQLISRYERHIACTRLPDLRESMRRSLRQRAEAVAEAIERSGRSAQIELVCTLICAVDGSVVSALVEGRDPRAAALATVVDLIDVLAPVDQRPVPF

SEQ ID NO: 52 - DNA, 621 bp, Mycobacterium tuberculosis
atgggcgtgacagcagcggtcactccaaaaggagaacgtcggcggtatgcgttggtcagcgccgccgcggagctgctcggcgagggcgggttcgaggcggtacgccaccgggcggtggcgcggcgggccggtttgccgttggcgtctaccacctactacttctcgtcgctcgacgatttgatcgctcgcgcggtcgaacacatcggaatgatcgaggtggctcagctgcgagcccgggtcagtgcgctgtcccggcgacgtcgggggcccgagaccaccgccgttgtgctggttgacctgctggtgggggaaatgtccagtccggggcttgccgagcagctgatctcacgatacgagcgccatatcgcctgtacccgcctgcctgacctgcgcgaaagcatgcgccgcagcctgcgtcagcgcgctgaggccgtggccgaggccatcgagcgctccggccgctccgcacagatcgaactggtgtgtacgttgatctgtgcggtcgacggatcggtggtctcggcgctggtcgaagggcgggacccgcgtgccgctgcgctggcgacggtggtcgacctcatcgacgtgctcgcgcccgtcgaccagcgtccggtgccgttc

SEQ ID NO: 53 - protein, 259 aa, Mycobacterium tuberculosis
MYFVGVDLAWAGRNPTGVAAVDADGCLVGVGAARDDASVLAALRPYVVGDCLVAFDAPLVVANRTGQRPAEAALNRDFRQFEAGAYPANTEKPEFADVPRAARLARQLALDMDPLSSATRRAIEVYPHPATVALFRLPRALKYKAKPGRSVDLLKSELLRLMDGVEGLAQAGVRMQVAGQPDWVSLRRQVTVAQRKSDLRAAEDPIDAVVCAYVALYAQRRPADVTIYGDFTTGYIVTPSLPTDFRTAPDAGRRARARR

SEQ ID NO: 54 - DNA, 777 bp, Mycobacterium tuberculosis
atgtacttcgtcggcgtggacctcgcctgggccggccgcaatccgaccggtgtcgcggctgtcgacgcggacgggtgtctggtgggggtcggtgccgctcgcgacgatgcctccgtgctggcggcgctgcggccctacgttgtgggcgattgcctggtcgccttcgacgcgccgctggtggtggccaaccgcaccggccagcggccggcggaggccgcactgaatcgagacttccgacaattcgaggccggcgcgtatccggccaacaccgaaaagcccgagtttgccgacgttccacgcgccgcccggctggcccgccaactggcgctggatatggatcctctttcgtccgccacgcggcgggccatcgaggtctatccgcacccggctacggtggcgctgtttcggctaccccgcgcgctgaagtacaaggccaagccgggacgcagcgttgacctgctcaaatcggagctattgcgactgatggacggcgtcgaggggctcgcccaggccggggttcggatgcaggtagccggtcagccggattgggtctcgttgcgccggcaggtgacggtcgcgcagcgaaaaagcgacctgcgggccgccgaggatccgatcgacgccgtcgtatgcgcctacgtggcgttgtacgcccaacgccggcccgccgatgtcacgatctatggggacttcaccaccgggtacattgtcacgccgtcgctgcccaccgacttcagaacggcaccggacgctggtcgacgggcgcgagcacgtcga

SEQ ID NO: 55 - protein, 566 aa, Mycobacterium tuberculosis
VALTCTDMSDAVAGSDAEGLTADAIVVGAGLAGLVAACELADRGLRVLILDQENRANVGGQAFWSFGGLFLVNSPEQRRLGIRDSHELALQDWLGTAAFDRPEDYWPEQWAHAYVDFAAGEKRSWLRARGLKIFPLVGWAERGGYDAQGHGNSVPRFHITWGTGPALVDIFVRQLRDRPTVRFAHRHQVDKLIVEGNAVTGVRGTVLEPSDEPRGAPSSRKSVGKFEFRASAVIVASGGIGGNHELVRKNWPRRMGRIPKQLLSGVPAHVDGRMIGIAQKAGAAVINPDRMWHYTEGITNYDPIWPRHGIRIIPGPSSLWLDAAGKRLPVPLFPGFDTLGTLEYITKSGHDYTWFVLNAKIIEKEFALSGQEQNPDLTGRRLGQLLRSRAHAGPPGPVQAFIDRGVDCVHANSLRELVAAMNELPDVVPLDYETVAAAVTARDREVVNKYSKDGQITAIRAARRYRGDRFGRVVAPHRLTDPKAGPLIAVKLHILTRKTLGGIETDLDARVLKADGTPLAGLYAAGEVAGFGGGGVHGYRALEGTFLGGCIFSGRAAGRGAAEDIR

SEQ ID NO: 56 - DNA, 1698 bp, Mycobacterium tuberculosis
gtggcgttaacctgtaccgacatgagcgatgctgtagccggttcagatgccgaggggctcaccgctgatgccattgtcgtgggagccggattagcgggcctggtagccgcttgtgagttggccgaccgcggcctacgggtgctgatcctcgaccaggagaatcgggccaacgtgggcgggcaggccttctggtcgttcggcggtttgttcttggtcaacagtcccgagcagcgccgcttgggcatccgtgatagccatgagcttgctctgcaggattggctggggacggcggcgttcgaccggcccgaggactactggcccgaacaatgggcgcatgcttacgtcgatttcgcggcgggggagaagcgcagctggctgcgggcccgcgggctgaagatctttccgctggtgggctgggccgagcgtggtggttacgacgcgcaggggcacggcaactcggtgccccgtttccacatcacctggggtactgggccggctctggtcgacatattcgtgcgtcagctgcgtgatcgccccacggtgcgctttgcgcaccgccaccaggtcgacaaactgatcgtcgagggtaacgcggtgacaggcgttcggggtaccgtgctggagccctcggatgagccgcgcggcgcgccttcgtcgcgaaagtctgtggggaaattcgagtttcgcgcgtcagcggtgatcgtcgccagtggtggtatcggtggcaatcatgagctggtgcgcaaaaactggccgagacggatgggccgcattcccaagcaactgttgagcggggtgcccgcgcacgttgatggcaggatgatcggcatcgctcaaaaggccggggctgcggtgatcaatccggaccggatgtggcattacaccgaaggcattaccaactacgacccgatctggccgcggcacggtatccggattattccggggccgtcgtcgctatggctggatgccgcgggcaagcggttgccggtaccgttgtttcccgggttcgacaccctcggcacattggagtacatcaccaagtctggacatgactacacctggttcgtgttgaatgccaagataatcgagaaggaattcgcgctgtccggtcaggagcagaaccctgacttgaccggtcggcgcctgggccagctgttgcgctctcgggctcacgccggcccgcccggaccggtgcaggcattcatcgatcgtggtgtggactgcgtccacgcgaactcgttgcgcgagttggtggccgcgatgaacgagttgcccgatgtggtgccgctggactacgagacggtggcagccgcggtcactgcgcgcgatcgtgaggtggtcaataagtacagcaaggatggacagatcaccgcgattcgtgccgctcgccgctaccgaggcgaccgatttggccgggtggtggcgccacatcggttgaccgatccgaaggccgggccgctgatcgcggtcaagctgcacatcctgactcgaaagacgttgggtggcatcgaaactgacttagatgctcgggtgctcaaggccgacggtacgccactggccgggttgtatgcagccggcgaggtcgccgggttcggcgggggcggtgtccatggctaccgggccttggagggcaccttcctgggtggatgcatattttccggccgcgctgccggccgcggggccgccgaggatatccgc

SEQ ID NO: 57 - protein, 242 aa, Mycobacterium tuberculosis
MTLANNGTGMDHFLTPTEYLDAGHPLVRTTAATLIRDAVSDTERVRRIYYYVRDVPYDVLASFRYLAQGHHRASDVIGHGVAFCMGKASSFVALCRAAGVPARIAFQTIDAPDKEFLSPQVRALWGGRTGRPFPWHSLGEAYLGRRWVKLDATIDAPTAARLGKPYRQEFDGATPIPTVEGTILRENGSYADYPSAVAQWYERIAQSVLKALQSTEVHALVAADEELWTGPPVELADATHRL

SEQ ID NO: 58 - DNA, 726 bp, Mycobacterium tuberculosis
atgacgctagccaacaatggaaccggcatggaccactttctgacgcccacggagtacctcgacgcgggccatccgctcgttcgtacgacggcagcaaccctcatccgggacgcggtgtcggataccgagcgggtcaggcggatctactactacgtgcgcgacgtgccatacgacgtcctcgcgtcctttcgctacctcgcgcagggacatcaccgcgccagcgacgtgatcggccacggggtcgccttctgcatgggcaaggcaagttccttcgtcgccctgtgccgagccgccggtgtcccggcccgtatcgcgttccagacgatcgacgcccccgataaggagtttctgtccccgcaggtacgtgccctatggggaggccgaactggccggcccttcccgtggcactcgctgggtgaggcatatcttggtcggcgatgggtcaagctggacgccaccatcgacgcacccaccgccgcccgcctcggcaagccctaccggcaagaattcgacggagctaccccgatcccgacggtggaaggaaccatcctgcgggaaaacggcagctacgccgactatcccagcgcggtcgcgcaatggtacgaacgaatcgctcagtcggtcctgaaggcgttgcagtccaccgaagtacacgccttggtagccgctgacgaggaactgtggaccggccccccggttgaattggccgacgcaacccaccgactg

SEQ ID NO: 59 - protein, 499 aa, Mycobacterium tuberculosis
MTAAQQDQAPMATPGCREGETYDVVVLGAGPVGQNVADRARAGGLRVAVVERELVGGECSYWACVPSKALLRPVIAISDARRVDGAREAVDGSINTAGVFGRRNRYVAHWDDTGQADWVSGIGATLIRGDGRLDGPRRVVVTKSSGESVALTARHAVVICTGSRPALPDLPGITEARPWTNRQATDNSTVPDRLAIVGAGGVGVEMATAWQGLGASVTLLARGSGLLPRMEPFVGELIGRGLADAGVDVRVGVSVRALGRPNPTGPVVLELDDGTELRVDEVLFATGRAPRTDDIGLETIGLTPGSWLDVDDTCRVRAVDDGWLYAAGDVNHRALLTHQGKYQARIAGTAIGARAAGRPLDTTSWGMHATTADHHAVPQAFFTDPEAAAVGLTADQAAQAGHRIKAIDVEIGDVVMGAKLFADGYTGRARMVVDVDRGHLLGVTMVGPGAAELLHSATVAVAGQVPIDRLWHAVPCFPTISELWLRLLESYRDSFYLLV

SEQ ID NO: 60 - DNA, 1497 bp, Mycobacterium tuberculosis
atgaccgcggcccaacaggaccaggcgccaatggcaacacccggctgccgtgagggtgaaacgtatgacgtcgtcgtgctcggcgcgggacccgttggacagaacgtcgccgatcgtgcccgcgcggggggcctgcgtgtcgcggtggtggagcgcgaactcgtcgggggtgaatgctcctattgggcctgtgtgcccagcaaagccttgctgcgtccggtcatcgcgatctctgacgcccgacgggtcgacggcgcgcgcgaagcagtcgacggctcgatcaacacagccggcgtctttggccgccgcaaccgctatgtggcccactgggacgacaccggccaggccgactgggtgagtggaatcggcgcgacgctgatacgcggtgacgggcgattggacggtccgcgccgcgtcgtcgtcaccaagtcgagcggcgaaagcgtggcgctgaccgcccggcatgccgttgtcatctgcaccggaagccggccagcactccccgaccttcctggcatcaccgaagcccggccatggaccaatcgccaagccaccgacaacagtacggtccccgaccggcttgcgatcgtcggcgccggcggcgtcggtgtggagatggcgaccgcctggcagggactgggcgcctcggtgaccctgctggctcggggatctggcctgctgccccgaatggaaccgtttgtgggggaactcatcggtcgcggactggccgacgccggcgttgacgtgcgcgtgggagtatcggtacgcgcgctgggccgccccaacccaactggcccagtggtcctcgagctggacgacggtaccgagctgcgggtcgacgaggtactcttcgccaccggccgagcaccgcgaaccgacgacatcggcttggagacaataggactgacgccgggcagctggctggacgtcgatgacacctgccgagtgcgggctgttgacgacggctggctctatgccgccggcgacgtcaaccatcgcgcgttgctgacccaccaaggcaaataccaggcgcggatcgccggcaccgcgatcggcgcccgtgccgccggacgaccgctagacaccacgtcgtggggcatgcacgcgaccaccgccgaccatcacgcggtgccgcaggcattctttaccgaccccgaagccgcagcggtcggcctgacagctgatcaggccgcacaggctggtcaccggatcaaagcgatcgatgtcgaaatcggcgatgtcgttatgggagccaagctctttgccgacggatacaccggcagggcgcgcatggtggtcgacgtcgatcggggccatctgctgggcgtgaccatggttggcccgggcgccgccgagctgttgcattcggccaccgtcgccgtcgccggccaggtgccaatcgatcggttgtggcacgccgttccgtgcttcccgaccatcagcgaactgtggctgagacttcttgaatcctaccgagattcgttttacctgctggta

SEQ ID NO: 61 - protein, 108 aa, Mycobacterium tuberculosis
MSGGSSRRYPPELRERAVRMVAEIRGQHDSEWAAISEVARLLGVGCAETVRKWVRQAQVDAGARPGTTTEESAELKRLRRDNAELRRANAILKTASAFFAAELDRPAR

SEQ ID NO: 62 - DNA, 324 bp, Mycobacterium tuberculosis
atgtcaggtggttcatcgaggaggtacccgccggagctgcgtgagcgggcggtgcggatggtcgcagagatccgcggtcagcacgattcggagtgggcagcgatcagtgaggtcgcccgtctacttggtgttggctgcgcggagacggtgcgtaagtgggtgcgccaggcgcaggtcgatgccggcgcacggcccgggaccacgaccgaagaatccgctgagctgaagcgcttgcggcgggacaacgccgaattgcgaagggcgaacgcgattttaaagaccgcgtcggctttcttcgcggccgagctcgaccggccagcacgc

SEQ ID NO: 63 - protein, 217 aa, Mycobacterium tuberculosis
MLVGAQCRDLLHWRFCRGVPPRATNDTDIAGTLNNWDHFEAIRATFRALGSTGHRFLIADRAVDALPFGEVESPTGTTRHPPGNQLMNVHGCTDAYLRADVLPLPGGLTVHLPQPPNYAVLKLHAWLDRSADHDYKDGPDLALVVHWYAGDLDRLYAKPDQWALRRHDFDLRTAAAALLGHDMRASVSAPEAAVLATRATQADHDLLAQHFAVGRPG

SEQ ID NO: 64 - DNA, 651 bp, Mycobacterium tuberculosis
atgctcgtcggggcacagtgccgcgatctactgcactggcgcttctgccgcggggtgccgccgcgggccaccaacgacaccgatatcgcagggaccctgaacaattgggaccacttcgaggcaattcgggccaccttccgcgccctgggcagcaccgggcaccgattcctgatcgccgaccgcgccgtcgatgccctcccgttcggcgaggtggagtcgcccaccggcacaacccgccatcccccaggcaaccagctcatgaacgtccacggatgcaccgacgcctacctgcgtgccgatgttctgcctctccctggcggcctgacagtccaccttccccaaccgccgaactatgcggtcctcaaactgcacgcatggctcgatcggtccgcggaccacgactacaaagacggcccagatctggccttggtggtgcactggtacgccggcgacctcgaccggctttacgccaaaccagaccagtgggcgctacgccgtcacgacttcgacctacgcaccgccgctgccgcgctgctcggccacgacatgcgcgccagtgtcagcgcaccggaggccgccgtgctggcgacgcgcgccacacaggccgaccacgacctgctggcccagcacttcgccgtgggtcgaccgggc

SEQ ID NO: 65 - protein, 342 aa, Mycobacterium tuberculosis
MDQIGADLAEAVERHLTEYGVRVLGGLSALNSAHPESLDLEIDAHPLTITALYLPHLSATAALQAWDTAGAGSPLLVVGPRLHPSSAETLRARGLWYIDGAGNAYLRHQGGLLIDVRGRRSAVSAQPGTLGDGLHSDGPRNPFTPKRAQVVCVLLDAPQLVDAPLRAIAASAGVSVGMAKETMDTLRTTGFFEHLGSRRRLVRTDELLDLWAAAYPGGLGRANKLLVASGDIHTWSAPDGLAVAVSGEQALPDEIRNPESLMLYVDTPAPGLPADLLIHNRWHRDPHGSIVIRKLFWRNLPDEQPGLAPTALIYADLLASREPRQVEVAHLMRRQDERLARL

SEQ ID NO: 66 - DNA, 1026 bp, Mycobacterium tuberculosis
atggatcagatcggggctgacctcgctgaggccgtcgagcgtcacctcaccgaatacggagtgcgggtgctcggtggcctatcagcattgaactccgcgcatcccgaatcactagaccttgagatcgacgctcaccccctcacgatcactgccctctaccttcctcacctgtcggcaacggcagcactgcaggcctgggataccgccggcgctggttcgccgctgcttgtggtgggcccgcgtctgcatccgtcgagcgctgaaacgctgcgggctcgcggactctggtacatcgacggagctgggaacgcttatttgcggcaccagggtggcctgctcatcgacgtgcgcggccgacggtcagctgtgtccgcacaaccgggcaccctcggtgacggactgcacagcgatggaccgcgtaacccgtttacccccaagcgcgcgcaggttgtctgcgtactgcttgacgcaccgcaactggtcgacgcgccgctgcgtgcgatcgccgcgagcgccggcgtctcggtcggtatggccaaggagacgatggatacgttgcgcactaccggcttcttcgaacacctcggctcccgccgcaggctggtgcgcaccgatgagctgctggacctgtgggcggctgcctatccggggggtctgggccgggccaacaaactcctggtcgccagtggtgatatccacacgtggtccgcacccgacggactcgcagtggcggtcagcggggaacaggccctgcccgacgaaatccgcaatcccgaatcactgatgctctacgtcgacaccccagcgcccgggctacccgccgacctgcttatacacaaccgctggcaccgcgacccacacggcagcatcgtgatccgaaagctattctggcgcaacctacctgacgagcaaccggggttggctcccacggccttgatctatgccgacctccttgcctcgcgcgagccgcgccaggtcgaagtcgcccacctcatgagaaggcaggatgagcgactcgcccgatta

SEQ ID NO: 67 - protein, 286 aa, Mycobacterium tuberculosis
VEGTIAVPGGRVWFQRIGGGPGRPLLVVHGGPGLPHNYLAPLRRLSDEREVIFWDQLGCGNSACPSDVDLWTMNRSVAEMATVAEALALTRFHIFSHSWGGMLAQQYVLDKAPDAVSLTIANSTASIPEFSASLVSLKSCLDVATRSAIDRHEAAGTTHSAEYQAAIRTWNETYLCRTRPWPRELTEAFANMGTEIFETMFGPSDFRIVGNVRDWDVVDRLADIAVPTLLVVGRFDECSPEHMREMQGRIAGSRLEFFESSSHMPFIEEPARFDRVMREFLRLHDI

SEQ ID NO: 68 - DNA, 858 bp, Mycobacterium tuberculosis
gtggaggggacaatcgcggtcccgggtggacgcgtctggttccagcggattggtggcggtcctggtcgtccgctgcttgtagtgcacggtgggccgggcttgccgcacaactacttggccccactgcgacggttgtctgatgagcgggaggtcatcttctgggaccagctcggttgcggaaattccgcatgtccgtcagacgtagacctttggacgatgaaccgctcagtggccgagatggcaaccgtggcggaagcccttgcccttacccgctttcacatcttcagccattcgtggggtgggatgctggcacagcagtacgtgctcgacaaggcgcctgacgccgtcagtctgaccatcgcgaacagcacggcttcgatacccgaattttcggccagtctggtcagcttgaagtcgtgcttggacgtggcaactcgctcggcaattgaccgtcacgaggcggccggcaccacccattccgccgaataccaggccgcgatcagaacctggaacgagacttatctgtgccgcacccgcccctggccccgggaactcacggaagcattcgccaacatgggaaccgagatcttcgagacgatgtttgggcccagcgactttcgcatcgttgggaatgttcgagactgggacgtcgtcgaccggttggccgacatcgcggtgccgaccttgctggtggtgggccgtttcgacgaatgttcgcctgagcacatgcgagaaatgcagggccggattgcgggctcgcgattggaattcttcgagtccagttcccacatgccgttcatcgaagagccggcgcgattcgaccgggtgatgcgtgaattccttcggctgcacgatatt

SEQ ID NO: 69 - protein, 419 aa, Mycobacterium tuberculosis
MGARAIFRGFNRPSRVLMINQFGINIGFYMLMPYLADYLAGPLGLAAWAVGLVMGVRNFSQQGMFFVGGTLADRFGYKPLIIAGCLIRTGGFALLVVAQSLPSVLIAAAATGFAGALFNPAVRGYLAAEAGERKIEAFAMFNVFYQSGILLGPLVGLVLLALDFRITVLAAAGVFGLLTVAQLVALPQHRADSEREKTSILQDWRVVVRNRPFLTLAAAMTGCYALSFQIYLALPMQASILMPRNQYLLIAAMFAVSGLVAVGGQLRITRWFAVRWGAERSLVVGATILAASFIPVAVIPNGQRFGVAVAVMALVLSASLLAVASAALFPFEMRAVVALSGDRLVATHYGFYSTIVGVGVLVGNLAIGSLMSAARRLNTDEIVWGGLILVGIVAVAGLRRLDTFTSGSQNMTGRWAAPR

SEQ ID NO: 70 - DNA, 1257 bp, Mycobacterium tuberculosis
atgggagcgcgcgctatattccgcgggttcaaccgcccgagccgggtgttgatgatcaaccagttcggcatcaacatcggcttctacatgctgatgccgtacctggccgactacctagccgggccactggggctagccgcgtgggcggtgggtctggtgatgggcgtgcgcaatttctcccagcagggcatgttcttcgtgggtggcacgctggccgatcggttcggctacaagccactgatcatcgccggatgtctgatccgcaccggcgggtttgccttgctggtggtcgcccagtcgctgcccagtgtgctgatcgccgcggctgccacgggctttgccggcgcgctgttcaatcccgcggtgcgcggctatctcgcggccgaagccggggaacgcaagatcgaagcgttcgcgatgttcaacgtcttctaccagtcggggatcctgctcggcccgctggttggattagtattgctggcgctggatttccggatcacggtgctggccgccgccggtgtgttcggcctactcaccgtcgcgcagctggtcgcactgccccaacaccgggccgactcggagcgcgaaaaaacatcgatcctgcaggactggcgggtcgtcgttcgcaaccgtccgtttctgacgttagccgccgccatgaccggatgctatgcgctgtcgttccagatctatctggctctgcccatgcaggcgtcgatcctcatgccacgcaaccaatatctcttgattgcggcgatgttcgcggtatcgggtctggtcgccgtcggcgggcagctgcgcatcacccgctggttcgccgtcagatggggggccgagcgcagcctggtagtcggcgcgacgattttggcggcctcgttcatcccggttgcagtcatcccaaacggccagcggttcggcgtcgccgttgcggtcatggcattggtgctgtcggcgagtctgctggcggttgcctcggcagcgttgtttcctttcgaaatgcgtgccgtggtcgcactgtcgggcgaccggctggtggcgacccactacgggttctacagcaccatcgtgggcgtcggagtcctcgtcggaaatctggcgatcggatcgctcatgagcgccgcgcgccgcttaaataccgatgaaattgtttggggcggattgattctggtgggcatcgttgcggtggccgggctccgtcggttggacacattcacctcgggttcccagaacatgaccggtcggtgggctgcaccccgg

SEQ ID NO: 71 - protein, 593 aa, Mycobacterium tuberculosis
MSAKERGDQNAVVDALRSIQPAVFIPASVVIVAMIVVSVVYSSVAENAFVRLNSAITGGVGWWYILVATGFVVFALYCGISRIGTIRLGRDDELPEFSFWAWLAMLFSAGMGIGLVFYGVAEPLSHYLRPPRSRGVPALTDAAANQAMALTVFHWGLHAWAIYVVVGLGMAYMTYRRGRPLSVRWLLEPVVGRGRVEGALGHAVDVIAIVGTLFGVATSLGFGITQIASGLEYLGWIRVDNWWMVGMIAAITATATASVVSGVSKGLKWLSNINMALAAALALFVLLLGPTLFLLQSWVQNLGGYVQSLPQFMLRTAPFSHDGWLGDWTIFYWGWWISWAPFVGMFIARISRGRTIREFIGAVLLVPTVIASLWFTIFGDSALLRQRNNGDMLVNGAVDTNTSLFRLLDGLPIGAITSVLAVLVIVFFFVTSSDSGSLVIDILSAGGELDPPKLTRVYWAVLEGVAAAVLLLIGGAGSLTALRTAAIATALPFSIVMVVACYAMTKAFHFDLAATPRLLHVTVPDVVAAGNRRRHDISATLSGLIAVRDVDSGTYIVHPDTGALTVTAPPDPLDDHVFESDRHVTRRNTTSSR

SEQ ID NO: 72 - DNA, 1779 bp, Mycobacterium tuberculosis
atgtcagcgaaagaacgcggtgaccagaacgccgtcgtcgacgccctgcggagtattcagcccgcagtcttcattccggcttcagtggtcatcgtcgccatgatcgtcgtttccgtggtgtactcgagcgtcgccgagaatgcgttcgttcggctgaactccgcgatcaccggcggcgtcgggtggtggtacatcctggttgccaccgggtttgtggtattcgcgctgtactgcggcatttcccggattggcactatccggctgggccgcgacgatgagctccccgagttcagcttctgggcatggctggcaatgctgtttagtgccggtatgggtatcggcctggtcttctacggggtggccgagccgctcagccactacctgcggccaccgcggtcacgcggcgtgcccgcgcttactgatgcggcggctaaccaggcgatggcgctgacagtgttccactggggcctgcacgcctgggcaatttatgtcgtggttggcctcggtatggcgtacatgacctatcggcggggtcgccccttgtcggtgcgctggctgctggagccggtcgtgggtcggggccgtgtagagggcgccttggggcacgcggtggacgtcatcgccattgtcggaacactctttggtgtcgccacgtcactgggcttcggtatcactcagatcgcctccggcctggaatatctcggctggatccgggtggacaactggtggatggtcggcatgatcgccgccatcaccgccactgcgacggcgtcggtggtcagtggggtcagcaagggtttgaagtggctgtcgaacatcaatatggcgctggccgccgcattggccctgttcgtgttgttgctcgggccgacacttttcttgctgcagtcgtgggtgcaaaatttgggaggctacgtccagtcgcttccgcaattcatgctgcgcaccgcgccgttctcgcacgacggctggctcggcgactggactatcttctactggggttggtggatcagctgggctccgtttgtcgggatgttcatcgcgcggatttcgcggggacggacgatccgggagttcatcggggcggtgctgctcgttcccaccgtgatcgcctcgctatggtttacgatcttcggtgactcggcgttgttgcggcaacgcaacaacggcgacatgctcgtcaacggggcggtagacaccaacacatcgcttttccgattgctggacggtttgcctatcggggctattaccagcgttcttgctgtgctggtgatcgtgttcttcttcgttacgtcgtcggactccggttcgttggtcatcgacatcttgtcagcgggtggtgagctggacccgcccaagctgaccagggtctactgggcggtgttggagggggtagccgcggccgttttgctcctgatcggaggtgctgggtcactgaccgcgttgcggacggccgctattgccacggccctgccgttctcaatcgtcatggtggtggcgtgctatgcgatgaccaaagcgttccacttcgacctggccgccacacctaggctgctgcacgtcaccgtgcctgacgtggttgcggcaggaaaccggcgacgccacgatatctcggcgacgctgtcggggctcattgccgtccgtgatgtcgatagcggcacatatatagtccaccccgacaccggcgctctcaccgtcactgcaccaccagatccgttggacgatcatgtttttgagtctgatcggcacgtaacgcgaagaaacacaacatcatcgaga

SEQ ID NO: 73 - protein, 331 aa, Mycobacterium tuberculosis
MSFVNVAPQLVSTAAADAARIGSAINTANTAAAATTQVLAAAQDEVSTAIAALFGSHGQHYQAISAQVAAYQQRFVLALSQAGSTYAVAEAASATPLQNVLDAINAPVQSLTGRPLIGDGANGIDGTGQAGGNGGWLWGNGGNGGSGAPGQAGGAGGAAGLIGNGGAGGTGGAVSLARAGTAGGAGRGPVGGIGGAGGVGGAGGAAGAVTTITHASFNDPHGVAVNPGGNVYVTNFGSGTVSVINPATNTVTGSPITIGNGPSGVAVSPVTGLVFVTNFDSNTVSVIDPTTNTVTGSPITVGTAPTGVAVNPVTGEVYVTNFAGDTVSVIS

SEQ ID NO: 74 - DNA, 993 bp, Mycobacterium tuberculosis
atgtcgtttgtcaacgtggccccacagttagtgtccacagccgcggccgatgcagcgcggatcggctcggcgatcaacaccgccaacaccgcggcggcggcgaccacccaggtgttggccgccgcccaagacgaggtgtcaacggcgatcgccgcgctgttcggcagccacggccagcactatcaagcgatcagcgcgcaggtcgcggcctatcagcaacggttcgtgctggccttaagccaagctggcagcacctacgcggtcgccgaagcggccagcgcaacaccgctgcagaacgtgctcgatgcgatcaacgcacccgttcagtcgctgaccgggcgcccattgatcggcgacggcgcgaacgggatcgacgggaccgggcaagccggcggtaacggcgggtggctgtggggcaacggcggcaacggcgggtcgggggcacccggacaggccggcggcgccggcggggcggccgggttgatcggcaacggtggggccggcggcaccggcggcgcggtcagcctcgcccgcgccggcacggccggcggtgccggccgcggcccggtcggcggtatcggcggtgcgggtggggtcggcggtgccggtggggccgccggcgccgtcaccaccatcacccacgccagcttcaacgatccgcacggggtggcggtcaacccgggcggcaacgtctacgtcaccaatttcggcagcggcacggtgtcggtgatcaaccccgccaccaacaccgtcaccggctcccccatcaccatcggcaacggtccaagcggggtggcggtcagccccgtcaccggcctggtcttcgtgaccaacttcgacagcaacacggtgtcggtgatcgacccgaccaccaacaccgtcaccggctcccccatcaccgtcggcaccgctccgaccggggtggcggtcaaccccgtcaccggcgaggtttatgtcaccaacttcgccggcgacacggtgtcggtaatcagc

SEQ ID NO: 75 - protein, 251 aa, Mycobacterium tuberculosis
MRADVTAEHLTQVVRDIAVIDIDDGVAFNLDTSSVQEIRERADYPGLRVRVAMSVGPWQGIAAWDVSTGEPIAPWPTRVTIDRILGEPITLLGYAPETIIAEKGVTILERGITSTRWRDYVDIVQLDRRGIDDDELLRSARAVAQYRGATLEPVAPHLAGYGAVAQAKWATEHGRCQHCWRHWKPAHVGRRNMDLLDAKQVSEMIGVPVGTLRHWRHSDIGPASFTLGRRVVYRRDEVSRWISKRESATRR

SEQ ID NO: 76 - DNA, 753 bp, Mycobacterium tuberculosis
atgcgcgccgacgtcaccgccgagcatctcacccaggtggttcgcgacatcgccgtgatcgacatcgacgacggggtggcgttcaacctcgacacgagcagcgtgcaggaaattcgcgagcgggccgactacccgggcctgcgcgtgcgagtcgctatgtcggtcggaccgtggcagggcatcgcggcctgggatgtgtccaccggcgaaccgatcgcgccgtggcccacacgggtgaccatcgaccggatcctcggcgagccgatcacactcctgggctacgcgcccgagaccatcatcgccgagaagggagtgaccatcctcgaacgcggcatcaccagcacccgctggcgggactacgtcgacatcgtccaactcgaccgccggggcatcgacgacgacgagctgctccgctcggccagggcagtcgcacaataccgcggcgccactctcgaacccgtcgcgcctcacctggccggttatggcgcagtcgcgcaagcgaaatgggcgaccgaacacggacgctgccagcactgttggagacattggaaaccagcccatgtcgggaggagaaacatggatctgctggacgcaaaacaagtttcggagatgatcggcgttcccgtcggcactctacggcactggcggcactcggacatcggaccggcgagcttcaccttgggacggcgcgtcgtgtaccggcgcgacgaggtgtcgcgctggatctcaaagcgggagagcgcaactcgacgt

SEQ ID NO: 77 - protein, 254 aa, Mycobacterium tuberculosis
MSVDYPQMAATRGRIEPAPRRVRGYLGHVLVFDTSAARYVWEVPYYPQYYIPLADVRMEFLRDENHPQRVQLGPSRLHSLVSAGQTHRSAARVFDVDGDSPVAGTVRFNWDPLRWFEEDEPIYGHPRNPYQRADALRSHRHVRVELDGIVLADTRSPVLLFETGIPTRYYIDPADIAFEHLEPTSTQTLCPYKGTTSGYWSVRVGDAVHRDLAWTYHYPLPAVAPIAGLVAFYNEKVDLTVDGVALPRPHTQFS

SEQ ID NO: 78 - DNA, 762 bp, Mycobacterium tuberculosis
atgagcgtggattacccccaaatggctgctacccggggaagaatagaaccggccccgcggcgagttcgcggctatctcggacatgtgctcgtcttcgacaccagtgcggcgcgctatgtctgggaggttccctactacccgcagtactacatcccgctggcggatgtccgcatggagttcctgcgcgacgagaaccacccgcagcgagtgcagctgggtccgtcgcggctgcactccttggtaagcgccggtcagacccaccgatcggcggcgcgggtattcgatgtcgacggcgacagcccggtggcgggcaccgtgcgtttcaactgggatccgctgcggtggttcgaggaggacgagccgatctacggccatccgcgcaatccctatcagcgggccgatgcgctgcgctcgcaccgacacgtccgtgtcgagctggacggcattgtgctcgctgacacccgatcgcccgttctgctattcgaaactgggatacccacaaggtattacatcgatccggccgacatcgctttcgagcatctggagcccacctcgacgcagacgttgtgtccgtacaaggggacgacgtcgggctattggtctgtgcgcgtcggcgacgccgtgcaccgcgacctggcctggacgtatcactatccactgcccgccgttgccccgatcgccggcctggtggcgttttacaacgagaaggtcgacctcaccgtcgacggcgtcgccctgccgcggccgcacactcagttcagc

SEQ ID NO: 79 - protein, 120 aa, Mycobacterium tuberculosis
SFAGAEAANASQLQSIARQVRGAVNAVAGQVTGNGGSGNSGTSAAAANPNSDNTASIADRGTSAIMTTASATASSTGVDGGIAATYAVASQWDGGYVANYTITQFGRDFDDRLAVAIHFA

SEQ ID NO: 80 - DNA, 360 bp, Mycobacterium tuberculosis
tctttcgccggcgccgaggccgccaatgcgtcacagctgcagagcatcgcgcggcaggtgcggggcgccgtcaacgccgtcgccggtcaggtgacgggcaatggcggctccggcaacagcggcacttcggctgcggcggccaacccgaattccgacaacacagcgagcatcgccgataggggcacaagcgccatcatgaccacggcaagcgcgaccgcgtcttccacgggcgtcgatggcggaatagcggcgacgtatgcggtcgcctcgcaatgggatggtggctacgtggccaattacacgatcacccaattcgggcgcgacttcgatgaccgattggcggttgcaattcactttgcc

SEQ ID NO: 81 - protein, 470 aa, Mycobacterium tuberculosis
VATVAFVATASIVITPAAIVLLGPRLDALDVRRLVRRLLGRPDPVHKPVKQLFWYRSSKFVMRRWLPVGTAVVALLVLLGLPFLSVKWGFPDDRVLPRSASARQVGDILRDDFGHDPATQIPIVVPDARGLGPVELDSYAAELSRVPDVSAVAAPTGTFVDGSWVGTPRGATGLAEGSAFLTVSSTAPLFSRASDIQLKRLHQVAGPAGRSVVMAGVAQVNRDSVDAVTDRLPMVLGLIAAITYVLLFLLTGSVVLPAKALVCNVLSLTAAFGALVWIFQEGHFGALGTTPSGTLVANMPVLLFCIAFGLSMDYEVFLVSRIREYWLESGAARPARRSVAEVHAANDESVALGVARTGRVITAAALVMSMSFAALIAAHVSFMRMFGLGLTLAVAADATLVRMVVVPAFMHVTGRWNWWAPRPLAWLHERFGVSEAAEPVSRRRSHAGGLGKIAGRSDGQTIPASLTRNG

SEQ ID NO: 82 - DNA, 1410 bp, Mycobacterium tuberculosis
gtggctaccgtggcattcgtcgcgaccgcgtcgatcgtgatcaccccggccgcgattgtgttgctaggtcctcggctagatgcgttggacgtgcgccgactggtgcgtcggctgctgggccggcccgatccggtgcacaaaccggtcaagcaactgttctggtaccggtcgagcaagttcgtgatgcgccgttggctgccggtcggtacggctgttgtcgcgctgctggtgctgctcgggctgccgttcttgtcggtgaagtggggtttcccggacgaccgggtgttgccgcggtcggcgtcggcccgtcaagtcggcgatatcttgcgcgatgactttggccacgatcctgcgacgcagatacccatcgtcgtcccggacgctcgtggtctcggcccggtcgaacttgacagctacgcagccgagttgtcccgggtgcccgacgtatccgcggtagccgccccgacgggcacgttcgtagacggcagctgggtgggaacgccgcgcggggccaccgggttggctgagggcagcgcgttcctgacggtgagcagcacggcgccgctgttttcgcgagcctccgatatccagctcaagcggttgcaccaggtggcagggccggccggtcgatccgtcgtgatggccggtgtcgcgcaggtcaaccgcgacagtgtcgacgcggtgaccgatcggcttccgatggtgctagggctaattgccgcgatcacctacgtactgttgttcctgctcaccggcagcgtggtgctgccggcgaaagcgttggtttgtaatgtgttatcgctgaccgcggcgtttggcgcgttggtgtggatcttccaggaaggccatttcggtgccctgggaacgactccgagcgggacgttggtggcgaatatgccggtcctactgttttgcatcgcattcggtttgtccatggactacgaggtgtttctggtctccaggattcgggagtactggttggaatccggagccgcgcgacccgcgcgaagaagcgtcgcagaggtgcacgccgccaacgacgagagcgtcgcgctcggcgtggcccgcaccggtcgggtgatcaccgcggcagcgttggtgatgtccatgtcgttcgccgcgttgatcgctgcgcacgtgtcgttcatgcggatgttcggcctcggcctgactttagccgtggctgcagacgccacactggtgcggatggtcgtggtcccagcattcatgcatgtgacgggccgctggaattggtgggcaccgagacccctggcgtggctgcatgagcggttcggtgtcagcgaggcagcagagccggtttcgaggagacgttcccacgccggtgggttgggcaagattgccggacgaagcgacggtcagacgatccctgcctcgctgacgcgcaatggt

SEQ ID NO: 83 - protein, 216 aa, Mycobacterium tuberculosis
MTSGAAASASRVDHPLFARIWPVVAAHEAEAIRALRRENLAGLSGRVLEVGAGVGTNFAYYPVAVEQVIAMEPEPRLAAKARIAAADAPVPIVVTDKTVEEFRDTETFDAVVCSLVLCSVSDPGAVLAHLRSLLRRGGELRYLEHVASAGARGRVQRFVDATFWPRLAGNCHTHRHTERAILDAGFVVDSSRREWAFPAWVPLPVSELALGRAHRT

SEQ ID NO: 84 - DNA, 648 bp, Mycobacterium tuberculosis
atgacgtcaggcgcggccgcttcggcgtccagggtcgaccacccgcttttcgcccggatctggcccgtggtcgccgcacacgaagccgaagcaatacgagccctccgccgggagaatctggccggtttgtcggggcgggtgttggaagtcggggccggcgtcgggacgaactttgcctactacccggtggccgtcgaacaggtcatcgccatggagcccgagccgcggcttgctgccaaggcccgcatcgcggccgctgacgcacccgttccgatagtcgtgacggacaagacggtcgaggagttccgcgacaccgagacgtttgacgcggtggtttgctcgctggtgctgtgctcggtgagcgacccgggcgcggtgctggcgcacctgcgttcgctactacggcgaggcggggagctgcgctatctcgagcatgtggccagcgccggcgctcggggccgggtgcagcggttcgtcgacgcgacattttggcccaggctggcgggcaactgtcacacgcatcgccataccgaacgcgcgatcctcgacgccggattcgtggtggacagctcccggcgggagtgggcatttcccgcctgggtgccgctaccggtgtcagagttggctctgggccgcgcgcaccggacc

SEQ ID NO: 85 - protein, 108 aa, Mycobacterium tuberculosis; identical to SEQ ID NO: 61

SEQ ID NO: 86 - DNA, 324 bp, Mycobacterium tuberculosis; identical to SEQ ID NO: 62

SEQ ID NO: 87 - protein, 489 aa, Mycobacterium tuberculosis
VTNDLPDVRERDGGPRPAPPAGGPRLSDVWVYNGRAYDLSEWISKHPGGAFFIGRTKNRDITAIVKSYHRDPAIVERILQRRYALGRDATPRDIHPKHNAPAFLFKDDFNSWRDTPKYRFDDPNDLLHRVKARLAEPALAARIKRMDTLFNAIVAVLAVGYFAVQGVRLVEPSWMPLWAFVIAMVLLRSSLAGFGHYALHRAQRGLNRVFNNAFDLNYVALSLVTADGHTLLHHPYTQSEVDIKKNVFTMMMRLPWLYRVPVHTIHKFGHMLSGMAIRIVDVFRITRKVGVEESYGSWRAALPHFLGSAGVRLLLVSELVVFAIAGDFWPWALQFVATLWVSTFLVVASHEFEDDTQGGAVNGEDWGIDQLEHANDLTVIGNRYVDCFLSAGLSSHRVHHVLPFQRSGFANIVTEDVLREEAAKFGVEWLPAKGFITDRLPRLCRKYLLTPSRQAKERHWGFVREHCSPAALKASASYVVAGFVGIGSV

SEQ ID NO: 88 - DNA, 1467 bp, Mycobacterium tuberculosis
gtgacaaacgacctcccagacgtccgagagcgtgacggcggtccacgtcccgctcctcctgctggcgggccacgcttgtcagacgtgtgggtttacaacgggcgggcgtacgacctgagtgagtggatttccaagcatcccggcggcgccttcttcattgggcggaccaagaaccgcgacatcaccgcaatcgtcaagtcctaccatcgtgatccggcgattgtcgagcgaatcctgcagcggaggtacgcgttgggccgcgacgcaacccctagggacatccaccccaagcacaatgcaccggcatttctgttcaaagacgacttcaacagctggcgggacaccccgaagtatcgattcgacgaccccaacgatctgctgcaccgggtcaaagcgcggctagccgagccagcgctggccgcccggatcaagcgcatggacacactcttcaacgccatcgttgcagtactggccgtgggttatttcgcggttcagggtgtgcggttggtggaaccgagctggatgccgctgtgggccttcgtgattgcgatggttctgctgcgcagttcgttggccgggttcggtcattacgcactgcaccgcgcgcaacgaggcctcaaccgggttttcaacaatgccttcgatctcaactatgtggccttgtccttagtcaccgccgacggacacaccctgctgcaccacccgtatacccagagcgaggtggacatcaagaagaacgtgttcacgatgatgatgcggctaccgtggttgtatcgcgttcccgtacatacgattcacaaatttggccacatgctcagcggcatggcgatccggatcgtcgacgtcttcaggatcacgcgcaaggtaggtgtcgaggaatcctacggaagctggcgcgccgcgcttccacacttccttggatcggccggggtgcgcttgcttctggtgagtgaattggtggtcttcgcgatcgccggcgacttctggccctgggcactgcaattcgtagcgacgctgtgggttagtaccttcttggtggtggcgagccatgagttcgaggacgacacccagggcggtgccgtcaacggcgaggactggggcatagatcaactcgagcacgctaatgacctaacggtgatcgggaaccgctacgtcgactgcttcctgtcagccggcctgagctcccaccgagtccatcacgtgctgccgtttcagcgcagcggcttcgcgaacatcgtcaccgaggacgttttgcgtgaggaagcagcgaagttcggtgtcgagtggcttcccgcaaagggtttcatcaccgatcggctgccgaggctgtgtcggaagtatctgttgacgccgtcgcgccaagccaaggagcgtcattggggtttcgtccgcgagcactgctcgccggcggcattgaaagccagtgccagctacgtggttgcgggtttcgtcggaatcgggtcggta

SEQ ID NO: 89 - protein, 393 aa, Mycobacterium tuberculosis
MNVSAESGAPRRAGQRHEVGLAQLPPAPPTTVAVIEGLATGTPRRVVNQSDAADRVAELFLDPGQRERIPRVYQKSRITTRRMAVDPLDAKFDVFRREPATIRDRMHLFYEHAVPLAVDVSKRALAGLPYRAAEIGLLVLATSTGFIAPGVDVAIVKELGLSPSISRVVVNFMGCAAAMNALGTATNYVRAHPAMKALVVCIELCSVNAVFADDINDVVIHSLFGDGCAALVIGASQVQEKLEPGKVVVRSSFSQLLDNTEDGIVLGVNHNGITCELSENLPGYIFSGVAPVVTEMLWDNGLQISDIDLWAIHPGGPKIIEQSVRSLGISAELAAQSWDVLARFGNMLSVSLIFVLETMVQQAESAKAISTGVAFAFGPGVTVEGMLFDIIRR

SEQ ID NO: 90 - DNA, 1179 bp, Mycobacterium tuberculosis
atgaacgtctcagctgagagcggtgcgccgcgccgggccggccagaggcatgaggttggccttgcccagttgccgccggctccgcccaccacggtggcggtgattgaagggcttgcgacgggcacgccgcgtcgggtagtcaaccagtccgacgccgccgatcgggtcgccgagcttttcctcgatcccggtcagcgggaacggattccgcgggtgtatcaaaaatcgcggatcaccacgcgccggatggcggtcgacccgctcgacgccaaatttgatgtcttcaggcgggaacctgcgacgatccgtgatcggatgcatctgttctacgaacacgcggttccgctggcggtggacgtgagcaagcgtgccctggccggcctgccataccgtgccgccgagatcgggctgctggtgttggccaccagcaccggattcatcgcgccgggcgtggacgttgcgatcgtcaaagagctcgggctctccccgtcgatatcacgtgtcgtggtcaatttcatgggatgtgccgccgcgatgaatgccctgggcaccgccaccaactatgttcgtgcccacccggccatgaaggcgctggtggtgtgtatcgaattgtgctcggtgaacgctgtttttgccgacgacatcaacgacgtcgtcattcacagcttgtttggcgacgggtgcgcggcgttggtgatcggcgccagccaggttcaggagaagctcgagccaggcaaggtggtagtccgcagtagtttcagtcagctgctcgacaacaccgaagacggtatcgtgcttggcgtcaatcacaacggcatcacctgcgagctgtcggagaatctccccggctacatcttcagcggggtcgcaccggtggtgacagagatgttatgggacaatggattacagatatccgatatcgatctctgggcgatccatccgggtggccccaagatcatcgagcagtcggtgcgctcgctggggatctccgcggagctggcggcgcagagctgggacgtgctcgcccgcttcggcaacatgctcagcgtatcgcttatctttgtgctagagacgatggtgcagcaggcggagtcggccaaagccatctcgacgggggtggcgttcgcgttcgggccgggcgtcactgtcgaaggcatgctgttcgacatcatccgacgg

SEQ ID NO: 91 - protein, 326 aa, Mycobacterium tuberculosis
MNSEHPMTDRVVYRSLMADNLRWDALQLRDGDIIISAPSKSGLTWTQRLVSLLVFDGPDLPGPLSTVSPWLDQTIRPIEEVVATLDAQQHRRFIKTHTPLDGLVLDDRVSYICVGRDPRDAAVSMLYQSANMNEDRMRILHEAVVPFHERIAPPFAELGHARSPTEEFRDWMEGPNQPPPGIGFTHLKGIGTLANILHQLGTVWVRRHLPNVALFHYADYQADLAGELLRPARVLGIAATRDRARDLAQYATLDAMRSRASEIAPNTTDGIWHSDERFFRRGGSGDWQQFFTEAEHLRYYHRINQLAPPDLLAWAHEGRRGYDPAN

SEQ ID NO: 92 - DNA, 978 bp, Mycobacterium tuberculosis
atgaattcagaacacccgatgaccgaccgggttgtgtatcgatcgttgatggccgacaacctgcgatgggatgccctgcaattgcgcgacggcgacatcattatctcggcgccgtccaagagcggcctgacctggacacagcgcctggtgtccctgctggtgttcgacgggcccgacttgcccggacccttgtcgacggtgtccccgtggctcgaccagaccattcggcccatcgaggaagtggtcgctactctcgatgcccagcagcaccgccggttcatcaagacccacacgccgttggacggcctggtgctcgacgaccgcgtcagctacatctgcgtaggacgcgacccgcgcgatgccgcggtgtcaatgctgtaccaatcggccaacatgaacgaagaccggatgcggattctgcacgaggccgtagtgccgtttcacgagcgaatcgcccccccgtttgcggaactcggtcatgcgcgcagcccgaccgaggagttccgggattggatggaggggccgaatcagcctccccctggcataggtttcacacatctgaaggggatcggcactctggccaacatcctgcaccagctaggcacggtatgggtccgccgtcacctacccaacgtggccttgtttcattacgccgattaccaggcggacttggcgggcgagctgctccggccggcaagggtcctcggtatcgccgcgacccgcgatcgagcccgggacctggcgcagtacgccacgctggatgcgatgcgctcccgcgcgtcagaaatcgctcctaacaccaccgacggcatctggcacagtgacgagcgtttcttccgccggggcgggagtggcgactggcagcagttcttcaccgaagccgagcacctgcgctactaccaccgcatcaaccagctggcgccacctgatctgctggcctgggcacacgagggccgccggggatacgacccggccaac

SEQ ID NO: 93 - protein, 422 aa, Mycobacterium tuberculosis
VAEAGGGPISVIARHMQLIRDDFISELFDKMKAEIRGLDYDARMADLWRASITENFVTAVHYLDRDTPQSLVEAPAAALAYARAAAQRDIPLSGLVRAHRLGHARFLEVAMQYVSLLEPADRVSTIIELVNRSARLVDLVADQLIVAYEHEHDRWLSRRSGLQQQWVSELLADTPVDVPRAERALGYRLDGVHIAAVVWVDSAVPIGDVVAQFDQVRCLLAGELGPELGPVANSLMVPTDEREARLWFSPAPTRAFAPSRIRAAFESAGIRARLACGRVGDGLRGFRASLKQAERVKALALAGGARPGGRVMFYDDVAPVALLADDLEELRRFVTDVLGDLSVDDERNSWLRETLREFLLRNRSYVATADAMILHRNTIQYRVIQAMELCGQNLDDPDAAFRVQMALEVCRWMAPAVLRAKQ

SEQ ID NO: 94 - DNA, 1266 bp, Mycobacterium tuberculosis
gtggctgaagctggtggcgggcccatttcggtgatcgcccggcatatgcagttgattcgcgatgacttcatctccgagttgtttgacaagatgaaggcggagattcgggggctggattacgacgcgcggatggcggacctgtggcgggcgagcatcaccgagaatttcgtgacggccgttcactatttggatcgcgatacgccgcagtccttggtggaggctccagcggccgcgctggcatacgcccgcgccgcggcgcagcgtgatattccgttgtccgggttggttcgggcgcaccggctcgggcatgcgcgtttcttggaggtggcgatgcagtacgtgtcgctgctggagcccgctgaccgggtgtcgacgatcatcgagctggtgaatcgctccgctcgcctcgttgacctggtggccgaccagttgattgtcgcctatgagcacgaacacgatcgctggctgagtcgccgcagcggtctgcaacagcaatgggtcagcgagctgctcgccgataccccggtcgacgttccgcgggccgagcgcgcgttgggctatcggttggacggtgtgcatatcgccgcggtggtatgggtcgattcggcggtgcccatcggtgatgtggtggcgcaattcgaccaggtgcgctgcttgctggccggggagctgggccccgaactgggccccgtggcgaactcgctgatggtgccgaccgatgagcgcgaggcacggctgtggttttcgcccgcgcccacgcgggccttcgccccgtcgcggattcgcgcggcgttcgagtcggcgggaatccgggcgcgtttggcgtgcggtcgggtaggggacgggctgcgtgggttccgggcgtcgttgaaacaggccgaacgagtgaaggcgttggccctggccggtggcgcccggcccggcggccgggtcatgttttatgacgatgtcgcgccagtcgcgttgctggccgacgatctagaggaactgcggcggttcgtcaccgatgtgctgggtgacctgagtgttgacgacgagcgcaatagctggctacgcgagacgttacgggagttcttgctgcgtaaccgcagctacgtcgccacggccgacgcgatgatcctgcaccgcaacaccattcaataccgggtgatccaggcgatggaactatgcggacagaatctcgacgatcccgatgccgcgtttcgggtgcagatggcgctggaggtctgccgctggatggcaccggcggtgctccgcgccaaacaa

SEQ ID NO: 95 - protein, 287 aa, Mycobacterium tuberculosis
MKLARPDVFHPRVVLAGWPQQPAGDGDDAGLVAALRHRGLHAGWLSWDDPEIVHADLVILRATRDYPARLDEFLAWTTRVANLLNSRPVVAWNVERRYLRDLMDRGVPTVPGEVYVPGEPVRLPRKGQVFVGPTIGTGTRRCSARFAAEFVAQLHAAGQAVLVQPGGSGDETVLVFLGGEPSHAFTKQADTWRQTEPDFEIWDVGAAAVAGAAAQVGVDPGELLYARAHITGGSRDPRLLELQLVDPSLGWQWLDPDIRNLAQRDFALCVQSALERLGLGPFSHRRP

SEQ ID NO: 96 - DNA, 861 bp, Mycobacterium tuberculosis
atgaagcttgcccggccggacgtcttccatccgcgcgtcgttttggcgggttggccacagcagcccgccggtgacggcgacgatgctgggctggttgcggccctgcgccaccgcggcttgcatgctggttggctgtcttgggacgatcccgaaatagtccacgcggatctggtgattttgcgggctacccgcgattaccccgcgcggctcgacgagtttttggcctggactacccgcgtggccaatctgctgaactcgcggccggtggtggcctggaatgtcgagcgccgttacctacgtgacctgatggatcggggggtgccgaccgtgcccggcgaggtgtatgtgccgggagagccggtccggttgccacgcaaaggccaggtcttcgtcggtccgaccatcggtaccgggacacggcgctgtagtgcccggttcgctgccgagttcgtcgcgcaactgcacgcggccggccaggcggtgctcgttcagcccggaggttccggtgacgagaccgtgttggtcttccttggcggtgagccgtcgcatgcgtttaccaagcaggccgacacttggcgccagaccgagcccgacttcgaaatctgggacgtgggtgcggccgccgtggccggcgcggccgcgcaggtgggtgttgacccaggtgagctgctctacgcgcgggcccacatcacaggtggaagccgagatccccggttgctggaattgcaattggtggacccgtcgctgggctggcagtggctggacccagacatccgcaatcttgcccagcgtgacttcgcgctatgcgtccagtcagcgttggagcggctggggctgggcccgttctcccatcgacgccca

SEQ ID NO: 97 - protein, 280 aa, Mycobacterium tuberculosis
MTDPFLGSEALAAGVLTPYELRSRYVALHKDVYVPQGVELTAQLRAKALWLRSRRRGVLAGYSASAFHGAKWIDADLPAAIIDTNRRRAPGLQVWEERIEPDEICVIEGMRVTTPERTALDLTSRFPLDPAVAAVDALIQATDLKVADVEPLIERYRGRRGMKAARAALDLVDGGAQSPKETWLRLLLIRAGFPRPQTQIAVRNEWGWAEAHLDMGWQDIKVAAEYDGDHHLTSRYHYRKDILRHEKVQHRYGWIVVRVVAEDHPADIIRRVGEARAFRA

SEQ ID NO: 98 - DNA, 840 bp, Mycobacterium tuberculosis
atgacggatccctttctgggcagcgaggccctggctgcgggtgtattgacgccctacgaattgcgcagcaggtatgtcgcgctacataaagacgtgtacgtgccgcagggtgtggaactgaccgcgcaattgcgtgcaaaagcgctgtggctgcgctcgcgccgccgcggcgtgctggccggctactcggcttctgccttccatggcgccaagtggatcgacgcggatcttcccgccgcgatcatcgacaccaaccgccgccgtgccccggggctgcaagtctgggaagagcgcatcgagcccgacgagatctgcgtcatcgagggcatgcgcgtgaccacaccggagcgaacggcgctcgacctgaccagtcgatttccattggaccccgccgtcgcggccgtcgacgccctgatacaggccaccgatttgaaggtggccgacgtcgagccgctgatcgagcgctatcggggccgccgtggcatgaaggccgcaagagccgctctggacctcgtcgacggcggtgcccagtcccccaaggaaacctggctgcgcttgttgttgatccgcgccggctttccgcgcccccagacgcagatcgcggtgcgcaacgaatggggctgggcggaagcccatttggatatgggctggcaagacatcaaggtcgcggccgagtatgacggcgaccaccatctgaccagtcgctaccactaccggaaagacatcctccggcacgagaaagtccagcaccgctacgggtggatcgtggtccgggtcgtcgccgaggaccaccccgctgacatcatccgccgcgtgggcgaggcccgcgctttccgagcg

SEQ ID NO: 99 - protein, 334 aa, Mycobacterium tuberculosis
MMAASHDDDTVDGLATAVRGGDRAALPRAITLVESTRPDHREQAQQLLLRLLPDSGNAHRVGITGVPGVGKSTAIEALGMHLIERGHRVAVLAVDPSSTRTGGSILGDKTRMARLAVHPNAYIRPSPTSGTLGGVTRATRETVVLLEAAGFDVILIETVGVGQSEVAVANMVDTFVLLTLARTGDQLQGIKKGVLELADIVVVNKADGEHHKEARLAARELSAAIRLIYPREALWRPPVLTMSAVEGRGLAELWDTVERHRQVLTGAGEFDARRRDQQVDWTWQLVRDAVLDRVWSNPTVRKVRSELERRVRAGELTPALAAQQILEIANLTDR

SEQ ID NO: 100 - DNA, 1002 bp, Mycobacterium tuberculosis
atgatggccgcatcccacgacgacgacaccgtcgacgggttggcgacggccgtgcgcggcggtgaccgtgcggcgctgccacgggccatcacactggtcgagtcgacccgccccgaccatcgtgagcaggcgcaacagctgctgctgcgattgctgccggactccgggaacgcccatcgcgtcggcatcaccggggtcccgggggtgggcaagtcgactgccatcgaggcgctgggcatgcatctgatcgagcgcgggcatcgggtggcggtgctggcggtcgacccgtcgtcgacccgcacgggtggatcgattcttggtgataaaacccggatggcgcggctggcggtgcacccgaacgcctacatccggccgtccccgacgtcgggaacgctgggtggggtgacgagggccacccgggaaacggtggtgctgttggaggcggccggttttgatgtgatcctgatcgaaaccgtcggggtgggccagtccgaggtcgcggtggccaacatggtcgacacgttcgtgttgctgaccttggcccgcaccggtgatcagttgcagggcatcaagaagggcgtgctggagctcgccgacatcgtggtggtgaacaaggccgacggggagcaccacaaagaggcccggctggccgcccgggagctgtcggcggcgatcagattgatctatcctcgcgaagcactgtggcgcccaccggtgctcaccatgagcgcggtggagggcaggggactggccgagctgtgggacaccgtcgagcgtcatcgccaggtgctcaccggggccggcgaattcgacgcccgtcggcgcgatcagcaggtcgactggacctggcagctggttcgcgacgccgtcctggatcgggtgtggtccaatccgacggtgcgcaaggtccgctccgagctcgagcgtcgggtccgcgccggcgaactgaccccggccctggcggctcagcaaatactggagatagctaacctaacggatagg

SEQ ID NO: 101 - protein, 426 aa, Mycobacterium tuberculosis
MKFVLAVHGTRGDVEPCAAVGVELRRRGHAVHMAVPPNLIEFVESAGLTGVAYGPDSDEQINTVAAFVRNLTRAQNPLNLARAVKELFVEGWAEMGTTLTTLADGADLVMTGQTYHGVAANVAEYYDIPAAALHHFPMQVNGQIAIPSIPTPATLVRATMKVSWRLYAYVSKDADRAQRRELGLPPAPAPAVRRLAERGAPEIQAYDPVFFPGLAAEWSDRRPFVGPLTMELHSEPNEELESWIAAGTPPIYFGFGSTPVQTPVQTLAMISDVCAQLGERALIYSPAANSTRIRHADHVKRVGLVNYSTILPKCRAVVHHGGAGTTAAGLRAGMPTLILWDVADQPIWAGAVQRLKVGSAKRFTNITRGSLLKELRSILAPECAARAREISTRMTRPTAAVTAAADLLEATARQTPGSTPSSSPGR

SEQ ID NO: 102 - DNA, 1278 bp, Mycobacterium tuberculosis
atgaagtttgtcttggcggtccacggaacccgcggtgatgtcgaaccttgcgccgcggttggcgtggagctgcggcggcgaggccacgcagttcatatggcagtgccgcccaacctgatcgagttcgtcgagtcggcaggtctgaccggcgtcgcctacggcccggactcggacgaacagatcaacacggtcgcggcattcgtccgcaacctcaccagagcccagaatccgctcaacctcgcccgcgccgtcaaggaactattcgtcgaaggctgggcggagatgggcacgacgttgaccacgttggccgacggcgccgacctggtgatgacgggccagacatatcatggtgtggcagccaacgtcgccgagtactacgacattccggctgcggcactgcatcactttccgatgcaggtcaacggccaaatcgcgatcccgtcgataccgacgccggcgactctggtgcgcgcgacgatgaaggtctcatggcggctgtatgcgtacgtcagcaaggatgccgatcgcgcgcaacgacgtgaactgggcctaccgccagcaccggcgccggcggtgcgtcggctggcggaacgcggagcgcccgaaatccaagcctacgacccggtttttttccccggactggcggccgaatggagcgaccgccgcccgtttgtcggcccgctgaccatggagttacacagcgaacccaacgaagaactcgagtcgtggatcgccgccggaacaccacccatctacttcggcttcggcagcacgcccgtccaaacgcccgtccaaacgctcgccatgatctccgatgtctgcgcacagctcggcgagcgagccctgatctattctccggcagccaactccacccgcattcgtcatgccgaccacgtgaaacgtgtcggcctggtcaactattcgaccatccttcccaagtgccgcgcggtcgtccaccacggtggcgccggtaccaccgccgccggcctgcgagcgggaatgcccacgctgattctctgggacgtggccgatcaaccgatctgggccggtgccgtccaacgactcaaagtcggctctgccaaacgctttacgaacatcacccgcgggtcattgctcaaggagctacgatcgatcctggcgccggaatgcgccgcgcgggcacgtgagatctcgacacggatgacccggccgacagccgccgtcaccgcggccgcggacctgctggaggcgacggcacgccaaacgcctgggagcacgcctagcagctcgccgggcagg

SEQ ID NO: 103 - protein, 165 aa, Mycobacterium tuberculosis
VTQLPQPTWRWWQQRETEQVQSSHIDGEIVGALIPDLAVLHSEDASRAAVGREKHRCSLDPLGGGFRSRRASMPAGALLLSAVIAIQLDRMNARVFGDGWIGAQACMWVNKFHEESTVTALSPSSPIAQGSIARHPETMQSAYVRIAEGGSRDVAPAAQLQRRRP

SEQ ID NO: 104 - DNA, 495 bp, Mycobacterium tuberculosis
gtgactcagcttccacaaccaacctggcgctggtggcagcaaagagagacggagcaggtgcagtccagccacatcgacggagaaatagtcggcgcgttgatccctgacctggcggtgctgcacagcgaggatgcctcacgcgcggccgtgggaagggaaaagcatagatgctcgttggatcctctaggtggcggcttccgttcccgtcgtgcctcgatgccggccggcgcgcttctgctgtctgcggtcatcgcaatacaactggaccggatgaatgccagagtattcggcgatggctggatcggcgcgcaagcgtgcatgtgggtcaacaagtttcacgaggagagcaccgtcaccgcgttgtcccccagtagtccgatcgcgcagggctcgatcgcgcggcatccagagacgatgcaatcggcgtacgtgcgcatcgccgagggcggatcgcgcgatgtcgccccagccgcccagcttcagcgacgacggcct

SEQ ID NO: 105 - protein, 583 aa, Mycobacterium tuberculosis
MTAQHNIVVIGGGGAGLRAAIAIAETNPHLDVAIVSKVYPMRSHTVSAEGGAAAVTGDDDSLDEHAHDTVSGGDWLCDQDAVEAFVAEAPKELVQLEHWGCPWSRKPDGRVAVRPFGGMKKLRTWFAADKTGFHLLHTLFQRLLTYSDVMRYDEWFATTLLVDDGRVCGLVAIELATGRIETILADAVILCTGGCGRVFPFTTNANIKTGDGMALAFRAGAPLKDMEFVQYHPTGLPFTGILITEAARAEGGWLLNKDGYRYLQDYDLGKPTPEPRLRSMELGPRDRLSQAFVHEHNKGRTVDTPYGPVVYLDLRHLGADLIDAKLPFVRELCRDYQHIDPVVELVPVRPVVHYMMGGVHTDINGATTLPGLYAAGETACVSINGANRLGSNSLPELLVFGARAGRAAADYAARHQKSDRGPSSAVRAQARTEALRLERELSRHGQGGERIADIRADMQATLESAAGIYRDGPTLTKAVEEIRVLQERFATAGIDDHSRTFNTELTALLELSGMLDVALAIVESGLRREESRGAHQRTDFPNRDDEHFLAHTLVHRESDGTLRVGYLPVTITRWPPGERVYGR

SEQ ID NO: 106 - DNA, 1749 bp, Mycobacterium tuberculosis
atgaccgcccaacacaacatcgtggttatcggcggcggtggtgcgggtctgcgcgccgcgattgcgatagccgaaaccaatccgcacctggatgtggcgatcgtttccaaggtgtacccgatgcgcagccacaccgtctcggctgagggcggcgccgcggcggtgaccggtgacgacgacagcctcgatgaacacgcgcacgacacggtatccggtggcgactggctgtgtgaccaagatgcggtcgaggctttcgtggccgaggcgcccaaagagttggtgcagctcgagcattggggctgtccgtggagccgtaaaccagacgggcgcgttgccgttcgcccgttcggcgggatgaagaagctgcgcacctggtttgccgccgacaagacgggatttcacctcctgcacacgttgtttcaacggctgctcacctattccgacgtcatgcgctatgacgagtggttcgctacgacgctgctggtcgacgacggcagggtatgtggtctggtcgctatcgagttggcgaccgggcgcatcgagacgatccttgccgacgcggtgattctgtgcaccggcggatgcgggcgggtatttccattcaccaccaacgcgaacatcaagaccggcgacggcatggcgctcgcattccgcgcgggcgcgcccctaaaagacatggaattcgtccaataccaccccaccggactgccgttcaccgggatcttgatcaccgaggccgcacgagctgaaggcggctggctgctcaacaaagacggctaccgctacctccaggattacgacctcggcaagcccacgcccgagcccaggctgcgcagtatggagctcgggcccagggaccgactgtcgcaggccttcgtacacgagcacaacaaaggaaggacggtcgacaccccgtacggccccgtcgtctatctagacctgcggcacctgggggcggacctgatcgatgcaaagttgccgttcgtacgtgagctgtgccgcgactaccagcacatcgaccccgtggtcgaattggtcccggtacgaccggtagtgcactacatgatgggtggcgttcacaccgatatcaacggcgccacaacgcttcccgggctatatgccgcaggtgaaacagcctgcgtgagcattaatggcgccaaccgcctggggtcgaactcgctgcccgagctgctggtgttcggggctcgagcgggccgtgccgccgcggattacgcagcgcgccaccaaaagtcggaccgtggcccgtcgtcggcagtgcgggctcaggcccgcaccgaggctctacggctagagcgtgagctcagccgccatggccagggaggcgaacgaatcgcggatattcgggcggacatgcaggccaccttggaaagcgccgcgggtatttatcgtgacggacccaccctcaccaaagcggtcgaggagattcgggtgctgcaggaacgattcgccacggcgggcatcgacgatcacagccgcacattcaacaccgagctgactgcgctgctcgagttgtcggggatgctcgacgttgcactggcgatcgtcgaatcgggtttgcgccgagaagaatcccgtggcgcacaccagcgaaccgactttccgaaccgggacgacgagcatttcttggcgcacaccttggttcatagagaaagcgacggaacgctgcgggtcggctaccttccggtcactatcactcgctggccaccgggcgaacgcgtgtatgggagg

SEQ ID NO: 107 - protein, 386 aa, Mycobacterium tuberculosis
MKAATQARIDDSPLAWLDAVQRQRHEAGLRRCLRPRPAVATELDLASNDYLGLSRHPAVIDGGVQALRIWGAGATGSRLVTGDTKLHQQFEAELAEFVGAAAGLLFSSGYTANLGAVVGLSGPGSLLVSDARSHASLVDACRLSRARVVVTPHRDVDAVDAALRSRDEQRAVVVTDSVFSADGSLAPVRELLEVCRRHGALLLVDEAHGLGVRGGGRGLLYELGLAGAPDVVMTTTLSKALGSQGGVVLGPTPVRAHLIDAARPFIFDTGLAPAAVGAARAALRVLQAEPWRPQAVLNHAGELARMCGVAAVPDSAMVSVILGEPESAVAAAAACLDAGVKVGCFRPPTVPAGTSRLRLTARASLNAGELELARRVLTDVLAVARR

SEQ ID NO: 108 - DNA, 1158 bp, Mycobacterium tuberculosis
atgaaagccgccacgcaggcacggatcgacgattcaccgttggcctggttggacgcggtgcagcggcagcgccacgaggccggactgcggcgctgcctgcggccgcgtcccgcggtcgccaccgagctggacttggcctccaacgactatctcggtctgtcccgacatcccgccgtcatcgacggcggcgtccaggcgctgcggatctggggcgccggcgccaccgggtcgcgcctggttaccggcgacaccaagctgcaccagcaattcgaggccgagctcgccgagttcgtcggcgctgccgcgggattgctgttctcctctggctacacggccaacctgggcgccgtggtcggcctgtccggcccgggttccctgctggtgtccgacgcccgttcgcatgcgtcgttggtggatgcctgtcggctgtcgcgggcgcgggttgtggtgacgccgcaccgcgacgtcgacgccgtggacgccgcgctgcgatcgcgcgacgagcagcgcgccgtcgtcgtcaccgactcggtgttcagcgccgacggctcgctggcgccggttcgggagttgcttgaggtctgccggcgtcatggtgcgctgcttctggtggacgaggcgcacggcctgggtgtgcgtggcggcggacgcgggctgctctacgagttaggtctagcgggtgcgcccgacgtggtgatgaccaccacgctgtccaaggcgctgggcagccagggtggtgtggtgctcgggccgacgccggtgcgggcccatctgatcgatgctgcccggccgttcatcttcgacaccggtctggcgccggcggcggtgggtgccgcacgggccgcgctgcgcgtcttgcaggccgagccgtggcgaccgcaggcggtgctcaaccacgctggtgaacttgcgcggatgtgcggtgtggctgcggtgccggactcggcgatggtgtcggtgatcctgggcgagccggagtcggcagtggccgccgcggcggcctgcctggacgccggggtcaaggtgggctgcttccggccgccgacggtgcccgcgggtacgtcgcggctgcggctgaccgcgcgcgcatcgctgaacgccggcgagctcgagctggcccggcgggtgctgacggatgttctcgccgtggcgcgccgt

SEQ ID NO: 109 - protein, 136 aa, Mycobacterium tuberculosis
MTTTPARFNHLVTVTDLETGDRAVCDRDQVAETIRAWFPDAPLEVREALVRLQAALNRHEHTGELEAFLRISVEHADAAGGDECGPAILAGRSGPEQAAINRQLGLAGDDEPDGDDTPPWSRMIGLGGGSPAEDER

SEQ ID NO: 110 - DNA, 408 bp, Mycobacterium tuberculosis
atgaccaccacaccagcacgtttcaaccacttggtgacggtaaccgacctggaaacgggtgaccgcgccgtctgcgaccgcgaccaggtggccgagacgatccgggcgtggttcccggacgcgcccttggaggtgagggaagcgctcgttcggctgcaggccgcgttgaatcggcacgagcacaccggcgagctcgaagcgttcctgcggatcagcgtcgagcacgccgacgccgccggcggcgacgagtgcggcccggcgatcctggccggccgctccgggccggaacaagccgccatcaaccggcaactcggactcgccggcgacgacgagcccgacggcgacgacaccccgccgtggagccggatgatcgggcttggcggcggaagcccagcggaagacgagcgc

SEQ ID NO: 111 - protein, 170 aa, Mycobacterium tuberculosis
MAELRSGEGRTVHGTIVPYNEATTVRDFDGEFQEMFAPGAFRRSIAERGHKLKLLVSHDARTRYPVGRAVELREEPHGLFGAFEIADTPDGDEALANVKAGVVDSFSVGFRPIRDRREGDVLVRVEAALLEVSLTGVPAYSGAQIAGVRAESLTVVSRSTAEAWLSLLDW

SEQ ID NO: 112 - DNA, 510 bp, Mycobacterium tuberculosis
atggccgagctgcggtctggcgaaggccgaaccgtgcacggcaccatcgtgccctacaacgaggcgaccaccgtccgcgacttcgacggcgagttccaggaaatgttcgctcctggcgcttttcggcgctccatcgccgagcgcggccacaaattgaagctgctggtctctcacgacgctcgaacccgctacccggtgggccgggccgttgagttgcgggaggagcctcacggcttgttcggggcgttcgagattgcggacaccccggacggcgacgaggctttggcgaacgtaaaagctggtgtcgtcgactcgttttcggtgggtttccgaccgatccgggaccgtcgcgaaggggatgtgctggtgcgcgtcgaagcggcgctgttagaggtttccctaaccggcgttccggcctattcgggggcacaaatcgccggggtgcgcgcggaatcgcttacagtcgtttcccgttcgacagccgaagcctggctgtccctactcgattgg

SEQ ID NO: 113 - protein, 115 aa, Mycobacterium tuberculosis
MIRAVWNGTVLAEAPRTVRVEGNHYFPPESLHREHLIESPTTSICPWKGLAHYYNVVVDGPYGPVNPDAAWYYRRPSPLARRIKNHVAFWHGVTVEGESESRHGLARRVVAWLGK

SEQ ID NO: 114 - DNA, 345 bp, Mycobacterium tuberculosis
atgattcgtgctgtgtggaatggaacagtgctcgctgaggcgccgcgaaccgtacgggtggaaggcaaccactactttccgcccgagtcgctgcaccgcgagcatctaatcgaaagcccgaccacgtcgatatgcccatggaagggtctggcccattactacaacgtcgtcgtggacggcccctatggtccggttaacccggacgctgcctggtactaccgccggcccagtccactggctcgccggatcaaaaaccatgttgcgttctggcacggtgtgacggtcgaaggtgaatccgagagtcggcatggcttggcgcgccgggttgtggcgtggctcggcaaa

SEQ ID NO: 115 - protein, 236 aa, Mycobacterium tuberculosis
VQPYGQYCPVARAAELLGDRWTLLIVRELLFGPLRFTEIERGLPGISRSVLAQRLRRLQHDRIIEAVPEHTGGGYRFTVAGEELRPVLQTLGDWVSRWLMADPTPAECDPELLTLWISRRVNTEALPGRRVVVEFRYHGERPLWAWLVLEPGDISVCLHDPCLPVDLTVRGHPRDLYRVYSGRSTLAAEISAERIELDGLPAMRRAFPSWMAWSPFAPAMRQAVVSVDQMPEAHGG

SEQ ID NO: 116 - DNA, 708 bp, Mycobacterium tuberculosis
gtgcagccgtacggccagtactgcccggtagcgcgggcggcggagctgctgggggaccgctggacgctgctaatcgtgcgggagctgctcttcggcccgctgcggttcaccgaaatcgagcggggcctgcccggcatctcccgctcggtgctggcccagcggctacgccgacttcagcacgaccgcatcatcgaagcggtccccgaacacacgggcgggggctatcggttcacggtggccggcgaggagctacgccccgtgctgcagaccctgggggactgggtctcccgttggttgatggccgaccccactcccgccgaatgcgaccccgaactactcacgttgtggatctcccggcgcgtcaacaccgaggcccttcccggccggcgggtggtggtggagttccgctaccacggcgagcggccactgtgggcctggctcgtgttggaacctggggacatctcggtgtgcctgcacgatccatgcctacctgtcgacctcacggtgcgcggccatcctcgagatctgtatcgggtctacagcggccgcagcacactggccgccgagatctccgccgagcgcatcgaactggacggcctgccggcgatgcggcgcgcgttcccatcctggatggcttggagtcccttcgccccagccatgcggcaagccgtggtgtccgtagaccagatgccggaggctcatggtggg

SEQ ID NO: 117 - protein, 517 aa, Mycobacterium tuberculosis
LCPPIILSSATPTGTRCGTRHGRAVVTEYVRALDRLPHEIATAVVETVNCADPGAAFDELDAKINAGMKAYAIPGVAVAVWAGGQEYVKGYGVTNVDHPMPVDGDTVFRIGSTTKTFTGTVMMRLVERGKVDLDSPVRRYIPDFAVADESASATVTVRQLLNHTAGWDGRNGQDFGRGDDAVALYVKAMTRLPQLTPPGTAFAYNNSGLVVAGRIIELVAGTTYESTVQRLLLDPLQLAHTRYFSDQIIGLNVAASHSVVDGKPIAVTDFWTFPRSCNPTGGLMSTARDQLRYAQFHLGDGRAPNGEQILSRQSLKAMRSNPGAGGTLWVELTGMGVTWMLRPSAENVTIVEHGGTWKGQRSGFVMVPDRNFAMTVLTNSDGGFHMINDLFASDWALQRFAGLSNLPATPQRLGAVDLAPYEGRYIAKQVAQNGDLETTVIDFRARDGQLAGSMSTDDANPDGQNSANLGLAFYRPDYGLDLGPDNKPTGSRSNFVRGPDGNIAWFCSQHGRLFRRQ

SEQ ID NO: 118 - DNA, 1551 bp, Mycobacterium tuberculosis
ttgtgtccgccgatcatcttgagttccgcgacgccgaccggcacgcggtgcgggacgcgccatgggcgcgcggtcgtcaccgaatacgtgcgtgcgctagatcgactgccgcacgaaatcgccactgcagtggttgaaactgtcaactgcgcagaccctggtgcagcgttcgacgaactcgatgcaaaaatcaacgcgggcatgaaggcctatgcgattccgggcgtcgcggttgctgtctgggccggcgggcaagaatacgtcaaaggctacggggtcaccaatgtcgaccatccgatgcctgttgacggcgacactgtcttcagaatcggttccaccacaaagactttcacaggtacggtgatgatgcggctggtcgagcgaggcaaggtggacctggattcacctgtgcgccgctacatccccgacttcgcggtagccgacgaatcagccagcgctacggttaccgttcgccaactgctcaaccataccgcaggctgggatggtcgcaatgggcaggactttgggcgcggcgatgacgcggtggcgctctatgtcaaggcgatgacacgcctaccgcagctcacccctccgggaaccgcgttcgcgtacaacaattcaggtcttgtggttgcgggccgcatcatcgagcttgtcgccggaacaacctacgaatctacggttcagaggctgttgcttgacccgctgcagcttgctcacacgcgctacttttccgaccaaataatcggtctgaatgtggccgcatcgcatagcgtggtcgacggcaaaccgattgccgttactgacttttggacattcccgcgcagctgcaaccccaccggtgggttgatgtccacagcgcgagatcagctgcgttacgcacagttccacctcggcgacggcagggcgcctaacggtgagcagattctgagccgacaatcgctgaaggcaatgcgctctaaccctggggcgggcggaacactttgggtggaactgaccgggatgggcgtgacctggatgctgcggccctccgcggagaatgtgaccatcgttgagcacggcggcacctggaaggggcagcgctctgggttcgtcatggtgcccgatcgaaacttcgccatgaccgtgctcactaactctgatggcggatttcatatgatcaacgaccttttcgcatccgactgggcattgcagagattcgccgggctcagcaatcttccggccacgccgcaacgccttggtgccgtcgacctggcgccctacgagggccggtacatcgccaagcaagtcgcccaaaatggcgacctcgagacaacggtcatcgacttccgggccagggacggccagcttgctggaagcatgagcaccgacgatgccaacccggatggccaaaacagcgccaatctgggcctcgccttctatcggcccgactatgggctcgaccttggacccgacaacaagcccaccggcagtcgctccaacttcgtgcgcgggccggacggcaacatcgcctggttctgtagccagcacggccgtctgttccgacgccaa

SEQ ID NO: 119 - protein, 108 aa, Mycobacterium tuberculosis; identical to SEQ ID NO: 61

SEQ ID NO: 120 - DNA, 324 bp, Mycobacterium tuberculosis; identical to SEQ ID NO: 62

SEQ ID NO: 121 - protein, 365 aa, Mycobacterium tuberculosis
MSSTATSGAAVVSPAERVEVLFEELAELAGQRNAIDGRIVEIVAELDRDGLWGVTGARSVAGLVAWKMGCSSGNAHTIATVARRLPEFPRCARGMREGRLSLDQVGVIAGRAGEGSDAHYAQLAGVATVNQLRTALKLEPRPEPEPDFRPEPRPSITRSADEQFSCWRIKLPHVEAAKFDAALQSHLDALIAEYKRDHDNSDGVSDQRPPLPGNVEAFLRLVEAGWDAEVARRPHGQHTTVVMHLDVQERAAGLHLGPLLSESERRYLLCDATFEAWFERDGQVIGCGRTTRQINRRLRRALEHRDRTCVVPGCGATRGLHAHHIRHWQDGGATELANLVLVCPYHHRAHHRGLNRPGESGDSLI

SEQ ID NO: 122 - DNA, 1095 bp, Mycobacterium tuberculosis
atgtcctcgaccgcgacgtctggcgcagcggtagtcagtcctgccgagcgtgtggaggtgttgtttgaggagttggcggagttggccggtcagcgcaatgcgattgatgggcgcattgtggagatcgtggctgagctggatcgcgacgggttgtggggtgtgacgggggcgcggtcggtggcggggttggtggcctggaagatgggctgctcgtcaggcaacgcccacacgatcgccacggtggcgcggcggttgccggagtttccgcgctgcgcccggggtatgcgggaggggcggttgtcgttggatcaggttggggtgatcgcggggcgggcgggtgagggttcggatgcgcattatgcgcagttggccggcgttgccacggtgaatcagctgcggaccgcgctcaagttggaaccgcgacccgaacccgaaccggattttcggccggaaccgcggccctcgatcaccaggagcgccgatgagcagttcagttgttggcgaatcaagcttccgcacgtggaggcggcgaagttcgatgcggcgttgcagtctcatctggatgcgttgatcgccgagtacaagcgtgatcacgacaacagcgacggtgtgtcggatcagcggcccccgttgccgggcaatgttgaggcgtttctgcgtctggttgaggccggctgggacgccgaggtggctcgtcggccacatgggcagcacaccaccgtggtgatgcatctagacgtgcaggagcgtgccgctggcctgcacctgggtccgctgctcagcgagtccgaacgccgatatctgctctgtgatgccacctttgaggcctggtttgaacgtgacgggcaggtcattggctgcggtcgaacgactcgtcagatcaatcgtcggttgcgtcgtgcgcttgagcatcgcgaccgcacgtgtgtggttcccggttgtggggccacccggggtttgcacgcccaccacatccgacattggcaggacggtggggccaccgagctggccaacctggtgctggtgtgcccgtatcaccaccgggcacaccatcggggcctgaaccgccccggtgagtccggagactctctgatc

SEQ ID NO: 123 - protein, 434 aa, Mycobacterium tuberculosis
VRRSPKGSPGAVLDLQRRVDQAVSADHAELMTIAKDANTFFGAESVQDPYPLYERMRAAGSVHRIANSDFYAVCGWDAVNEAIGRPEDFSSNLTATMTYTAEGTAKPFEMDPLGGPTHVLATADDPAHAVHRKLVLRHLAAKRIRVMEQFTVQAADRLWVDGMQDGCIEWMGAMANRLPMMVVAELIGLPDPDIAQLVKWGYAATQLLEGLVENDQLVAAGVALMELSGYIFEQFDRAAADPRDNLLGELATACASGELDTLTAQVMMVTLFAAGGESTAALLGSAVWILATRPDIQQQVRANPELLGAFIEETLRYEPPFRGHYRHVRNATTLDGTELPADSHLLLLWGAANRDPAQFEAPGEFRLDRAGGKGHISFGKGAHFCVGAALARLEARIVLRLLLDRTSVIEAADVGGWLPSILVRRIERLELAVQ

SEQ ID NO: 124 - DNA, 1302 bp, Mycobacterium tuberculosis
gtgagacgttcgccgaaaggctccccgggcgcagttctcgacttgcagcgacgcgttgaccaggcggtatccgccgatcacgctgaactaatgacaattgccaaggatgccaacacgttctttggtgccgaatccgtgcaggacccctacccgctgtatgagcgcatgcgcgccgcaggctcggtccaccggatcgctaactcggacttctatgccgtgtgcggttgggacgctgtcaatgaggccatcggtcgtccggaggacttctcctcgaatttgaccgccacgatgacctatacggccgagggcaccgctaaaccgttcgagatggacccactcggcggacccacacacgtgttggccaccgccgacgatcctgcccacgccgtgcaccgcaagctcgtgctgcgtcacttggcggccaagcggatccgcgttatggagcagttcaccgtacaggctgccgaccggctgtgggtcgacggcatgcaggatgggtgcatcgaatggatgggcgccatggccaatcgcctaccgatgatggtcgtagctgagctcatcggcctgcccgaccccgacatcgcccagctggtgaagtggggatacgcggccactcagctactcgaagggttggtcgaaaacgatcagctcgtcgccgcgggtgtggcgttgatggagctcagcggttacatcttcgagcagtttgaccgtgccgcggccgatccgcgggacaatctgctcggtgagcttgccaccgcctgcgcatcgggggagctggacactctcaccgcccaggtcatgatggtcaccttgttcgccgccggcggcgagtccacggcggcgctgctgggcagcgcggtatggatactggcgacacgtcccgatatccagcaacaggtgcgcgcgaaccccgagctgctgggagcgtttatcgaagagacgctgcgttacgagccgccatttcgcggccactaccgccacgtgcgaaacgccaccaccttggacggcacggaactgcccgcggattcgcacctgctgctgttgtggggcgcggccaaccgcgatccagcccagttcgaggcacccggcgagttccgtcttgaccgtgcaggaggcaaaggccacatcagtttcggaaaaggggcccacttctgtgtcggcgctgcactggcacgcttggaggctcgaatcgtcttgcgtctgctgctcgatcgcacctcggtaattgaggcagccgatgtcggcgggtggttgcccagtatcctggtgcgccgcatcgagcggctagagctagctgtacaa

SEQ ID NO: 125 - protein, 99 aa, Mycobacterium tuberculosis
MAFVLVCPDALAIAAGQLRHVGSVIAARNAVAAPATAELAPAAADEVSALTATQFNFHAAMYQAVGAQAIAMNEAFVAMLGASADSYAATEAANIIAVS

SEQ ID NO: 126 - DNA, 297 bp, Mycobacterium tuberculosis
atggcgtttgttcttgtctgtccagatgcgctggccatcgcggccggtcagttgcgccatgttggatcggtgatagccgcgcggaatgcggtcgcggcaccggcaactgccgaattggccccggcggccgctgacgaagtatcagctttgactgcaacacaattcaacttccatgccgccatgtaccaagcggtcggcgcccaggcgatcgccatgaatgaggcgttcgtcgcgatgttgggcgccagcgcggattcttacgcggctaccgaagccgccaacatcattgctgtgagc

SEQ ID NO: 127 - protein, 778 aa, Mycobacterium tuberculosis
MVTRLLADLGADVLKVEPPGGSPGRHVRPTLAGTSIGFAMHNANKRSAVLNPLDESDRRRFLDLAASADIVVDCGLPGQAAAYGASCAELADRYRHLVALSITDFGAAGPRSSWRATDPVLYAMSGALSRSGPTAGTPVLPPDGIASATAAVQAAWAVLVAYFNRLRCGTGDYIDFSRFDAVVMALDPPFGAHGQVAAGIRSTGRWRGRPKNQDAYPIYPCRDGYVRFCVMAPRQWRGLRRWLGEPEDFQDPKYDVIGARLAAWPQISVLVAKLCAEKTMKELVAAGQALGVPITAVLTPSRILASEHFQAVGAITDAELVPGVRTGVPTGYFVVDGKRAGFRTPAPAAGQDEPRWLADPAPVPPPSGRVGGYPFEGLRILDLGIIVAGGELSRLFGDLGAEVIKVESADHPDGLRQTRVGDAMSESFAWTHRNHLALGLDLRNSEGKAIFGRLVAESDAVFANFKPGTLTSLGFSYDVLHAFNPRIVLAGSSAFGNRGPWSTRMGYGPLVRAATGVTRVWTSDEAQPDNSRHPFYDATTIFPDHVVGRVGALLALAALIHRDRTGGGAHVHISQAEVVVNQLDTMFVAEAARATDVAEIHPDTSVHAVYPCAGDDEWCVISIRSDDEWRRATSVFGQPELANDPRFGASRSRVANRSELVAAVSAWTSTRTPVQAAGALQAAGVAAGPMNRPSDILEDPQLIERNLFRDMVHPLIARPLPAETGPAPFRHIPQAPQRPAPLPGQDSVQICRKLLGMTADETERLINERVMFGPAVTA

SEQ ID NO: 128 - DNA, 2334 bp, Mycobacterium tuberculosis
atggtgacacgactgctcgccgacctgggcgcagacgttctcaaggtggaaccccccggcggcagcccaggacgccacgtgcggcccacgctggccggcaccagcatcgggttcgccatgcacaacgcgaacaaacgcagcgcagtgctcaacccgctcgacgagagcgaccgtcggcggttcttggacctcgccgccagcgccgacatcgtcgtcgactgtggtcttccgggacaggccgccgcgtacggggcatcgtgtgccgagttggccgatcgctaccgacacctggtggcgctgtcgatcaccgactttggcgctgccggtccgcggtcgtcatggcgcgcgaccgatccggtgctgtacgcgatgagtggtgctctctcgcggtcgggccctaccgccggcacgccggtactgccgccggacggtatcgcttcggcaaccgcagcggtgcaggcagcctgggccgtactggtcgcctatttcaaccgattacgttgtggtactggggattacatcgacttctcccggtttgacgccgtcgttatggcgttggatccccccttcggggcgcacgggcaggtcgcagccggcatccgcagcaccgggcgatggcggggacggcccaagaaccaggacgcttacccgatttatccgtgccgggacggctacgtacggttctgcgtgatggcgccgcggcagtggcgcgggctgcgccgctggttgggggagcccgaagattttcaggaccccaagtacgacgtgatcggcgcacgtttggccgcatggccgcagatcagcgtgttggtcgcgaagttgtgcgccgagaagaccatgaaggagttggtggcagccggccaagcgctcggggttcccattaccgcggtgctgacaccgtcgagaatcctggcctccgaacacttccaggcggtgggtgcgatcaccgatgccgagctcgttccgggggtgcgcaccggggtgcctaccggatacttcgttgtcgacgggaagcgcgccggtttccgtactccggcccccgccgcggggcaggacgaaccgcgctggctcgcggatccagcgccggtgcccccaccctcaggccgggtcggcggctatccattcgaaggtctgcggattcttgatctgggcatcatcgtggccggcggcgagctcagccggctgttcggcgacttgggcgccgaggtcatcaaggtcgaaagtgccgaccaccccgacgggttgcggcagacccgagtcggggatgcgatgagtgaatcattcgcgtggacccatcgcaatcacctcgcgctgggcctggacctgcgcaacagcgagggcaaagcgatcttcggtcgcctggtcgctgaatccgacgcggtgttcgccaacttcaaaccgggaacccttacctcacttgggttttcctacgatgtactgcacgccttcaacccccggatcgtgctcgccgggagtagtgcattcgggaaccgagggccgtggagcacccggatgggctacgggccactggtgcgcgccgccaccggggtcacccgtgtttggacatccgatgaggcgcagccggacaactctcggcatcccttctacgacgcgacgacgatcttccccgaccacgttgtcgggcgggtcggtgccctgctcgcgctggcggccctgatccaccgcgatcgaactggcggcggagcccacgtccacatctcccaggccgaagtcgtcgtcaatcagctagacaccatgttcgttgccgaggccgcccgagcgaccgacgttgccgagatccacccggacaccagtgtgcatgcggtctacccttgtgctggcgacgacgaatggtgcgtcatctcaatccgctccgacgatgaatggcgtcgcgcgacatctgttttcggccagcctgaattggcgaacgacccacgcttcggggcaagccggtcacgcgtggccaaccgttcggagttggtggccgcagtgtcggcctggaccagcacccgtaccccggtgcaagcggccggcgcgctgcaggcggccggagttgcggccggcccgatgaatcgcccgtcggatatcctcgaggatccccagctgatcgagcgaaacctgttccgcgacatggtgcatccgctgatcgcccgtccgctgcccgccgagacgggtccggctccgtttcgtcacattccgcaggcaccccaacgcccggcgccgctgcccggacaggacagcgttcagatctgccgcaagctgctcggcatgaccgcggacgagaccgaacgcctaatcaacgagcgcgtaatgttcgggccggccgtcactgcc

SEQ ID NO: 129 - protein, 1459 aa, Mycobacterium tuberculosis
MNFSTLPPEINSALIFGGAGSEPMSAAAVAWDQLAMELASAAASFNSVTSGLVGESWLGPSSAAMAAAVAPYLGWLAAAAAQAQRSATQAAALVAEFEAVRAAMVQPALVAANRSDLVSLVFSNFFGQNAPAIAAIEAAYEQMWAIDVSVMSAYHAGASAVASALTPFTAPPQNLTDLPAQLAAAPAAVVTAAITSSKGVLANLSLGLANSGFGQMGAANLGILNLGSLNPGGNNFGLGNVGSNNVGLGNTGNGNIGFGNTGNGNIGFGLTGDNQQGFGGWNSGTGNIGLFNSGTGNIGIGNTGTGNFGIGNSGTSYNTGIGNTGQANTGFFNAGIANTGIGNTGNYNTGSFNLGSFNTGDFNTGSSNTGFFNPGNLNTGVGNTGNVNTGGFNSGNYSNGFFWRGDYQGLIGFSGTLTIPAAGLDLNGLGSVGPITIPSITIPEIGLGINSSGALVGPINVPPITVPAIGLGINSTGALVGPINIPPITLNSIGLELSAFQVINVGSISIPASPLAIGLFGVNPTVGSIGPGSISIQLGTPEIPAIPPFFPGFPPDYVTVSGQIGPITFLSGGYSLPAIPLGIDVGGGLGPFTVFPDGYSLPAIPLGIDVGGGLGPFTVFPDGYSLPAIPLGIDVGGGLGPFTVFPDGYSLPAIPLGIDVGGAIGPLTTPPITIPSIPLGIDVSGSLGPINIPIEIAGTPGFGNSTTTPSSGFFNSGTGGTSGFGNVGSGGSGFWNIAGNLGNSGFLNVGPLTSGILNFGNTVSGLYNTSTLGLATSAFHSGVGNTDSQLAGFMRNAAGGTLFNFGFANDGTLNLGNANLGDYNVGSGNVGSYNFGSGNIGNGSFGFGNIGSNNFGFGNVGSNNLGFANTGPGLTEALHNIGFGNIGGNNYGFANIGNGNIGFGNTGTGNIGIGLTGDNQVGFGALNSGSGNIGFFNSGNGNIGFFNSGNGNVGIGNSGNYNTGLGNVGNANTGLFNTGNVNTGIGNAGSYNTGSYNAGDTNTGDLNPGNANTGYLNLGDLNTGWGNIGDLNTGALISGSYSNGILWRGDYQGLIGYSDTLSIPAIPLSVEVNGGIGPIVVPDITIPGIPLSLNALGGVGPIVVPDITIPGIPLSLNALGGVGPIVVPDITIPGIPLSLNALGGVGPIVVPDITIPGIPLSLNALGGVGPIVVPDITIPGIPLSLNALGGVGPITVPGVPISRIPLTINIRIPVNITLNELPFNVAGIFTGYIGPIPLSTFVLGVTLAGGTLESGIQGFSVNPFGLNIPLSGATNAVTIPGFAINPFGLNVPLSGGTSPVTIPGFAINPFGLNVPLSGGTSPVTIPGFTIPGSPLNLTANGGLGPINIPINITSAPGFGNSTTTPSSGFFNSGDGSASGFGNVGPGISGLWNQVPNALQGGVSGIYNVGQLASGVANLGNTVSGFNNTSTVGHLTAAFNSGVNNIGQMLLGFFSPGAGP

SEQ ID NO: 130 - DNA, 4377 bp, Mycobacterium tuberculosis
atgaatttttcaacattgccaccagagatcaactcggccctcatattcggcggggcgggatcagaacccatgtcggcggccgcggtcgcctgggaccaactggcgatggaattggcctcggcagcggcctctttcaactccgtgacgtcgggcctggtcggcgaatcgtggctcggaccgtcatcggcggcgatggccgctgcggtagcgccgtacctaggatggcttgccgcggcagcggcccaggcccagcggtcggcaacccaagccgcggccctcgtggccgagttcgaggctgtccgggcggcgatggtgcaaccggcgctggtggcggccaaccgctccgacctggtgtcattggtgttctcaaacttcttcgggcagaatgctccggcgatcgctgcgattgaggccgcatacgaacagatgtgggccatcgatgtgtcggtgatgtcggcctaccatgccggggcatcggcggtggcgtcggccctgacgccgttcactgcgccgccgcagaatctgacagacctgcccgcccagttggcggccgctccggcggccgtcgtcaccgcggcgatcaccagttccaagggtgtgctggcaaatcttagcttaggcctggcaaactcgggcttcggacagatgggcgccgctaaccttggcattttgaacttgggcagcctaaatcccggcggcaacaacttcggccttggaaatgtcggcagcaacaacgttggcttgggcaacaccggcaacggaaacatcggcttcggcaacacgggcaacggaaacatcggcttcggcctcaccggcgacaaccagcaggggttcggcggctggaactcggggaccggcaatatcggcttgttcaactcaggcaccggcaacatcggcatcggcaatacgggcaccggaaacttcggcatcgggaactcaggtaccagctacaacacgggtatcggcaacacgggccaagccaacacgggcttcttcaacgccggcatcgccaacactggcatcggcaacacgggcaactacaacacgggcagcttcaatctaggcagcttcaacacgggcgacttcaacacgggcagctccaacacaggcttcttcaaccccggcaacctcaacaccggcgtgggaaacaccggcaacgtcaacaccggtggattcaactctggcaactacagcaacggcttcttctggcgaggcgactaccagggcttgatcggcttctccggcacactgaccattcccgctgctggcctagacctcaacggcctcggctccgtcggccccatcaccatcccgtccatcaccattcccgaaatcggcctgggcattaacagttccggagcgttggtggggccgatcaatgttccgcctattactgttcccgccatcgggctgggcatcaacagtaccggggcactcgttggccccatcaacatcccgccgatcactctaaattctattggcctagagctatcggcgttccaggtcattaacgtgggatcgatttcgatccccgcgtctccgcttgcgatcggcttattcggcgtaaatcccaccgttggcagcataggcccgggtagcatatcgatacagctaggcactcctgagattcccgcgattccgccatttttccccggattccctccagattacgtgacagtgagtggtcaaatcggtcccatcaccttcttatcgggtggttatagtttgccggctattccgttgggtattgatgtgggtggagggttaggcccgtttacggtgttcccggatggctactcacttccggcaatcccgttgggtattgatgtgggcggagggttaggcccgtttacggtgttcccggatggctactcacttccggcaatcccgttgggtattgatgtgggcggagggttaggcccgtttacggtgttcccggatggctactcacttccggcaatcccgttgggtattgatgtgggcggcgccatcggccccctcactaccccgccaatcacgatcccctcaatcccgttgggcatcgacgtgtccggcagcctcgggccgatcaacatcccgatcgaaatcgcgggcaccccaggcttcggaaactcgaccaccaccccgtcatcgggcttcttcaacagcggtacgggcggcacatcgggtttcgggaacgtcggttcgggcggatctggcttctggaacattgctgggaatctcggcaactccggattccttaacgtcgggccactgacatcgggaatcttgaacttcggcaacacagtctcaggcctctacaacaccagcacgctgggcctagcgacatcggcctttcactccggcgtcggtaacaccgacagccaactcgccggcttcatgcgcaacgccgcaggtgggacgttattcaacttcggcttcgccaacgacggcacactcaacttgggcaacgcaaacctcggcgactacaacgtgggtagcggaaacgtcggtagctacaacttcggtagcggaaacatcggcaacggaagtttcggtttcggaaacatcggaagcaacaacttcggttttggaaacgtcggcagcaacaaccttgggtttgcaaacacgggtccggggttgacggaggccctgcacaacattggctttgggaacatcggcggcaacaactacggcttcgcgaacatcggtaacggcaacatcggcttcggcaacacgggcactggaaatattggtatcgggctcaccggcgacaatcaggtcggattcggggcgctgaactccggcagcggcaacatcggcttcttcaactccggcaacggcaacatcggcttcttcaactcaggcaacggaaacgtcggcatcggcaactccggcaactacaacaccggcctgggtaacgtgggcaacgccaacacgggcctgttcaacaccggcaacgtcaacactggaatcggcaacgcaggaagctacaacacaggcagctacaacgccggcgacaccaacacgggcgacctcaacccgggcaacgccaacacggggtacctaaacctcggcgacctcaacaccggctggggaaacattggcgaccttaacaccggcgccctgatctcgggcagctacagcaacggcatactgtggaggggcgattaccagggtctgattggctactcagacacactcagcattcccgccatcccactgagcgtcgaagtgaatggtggcatcggtccgattgtggtgccggatattactattcctggtattccgttgagcctgaacgcgctgggtggtgtcggtccgattgtggtgccggatattactattcctggtattccgttgagcctgaacgcgctgggtggtgtcggtccgattgtggtgccggatattactattcctggtattccgttgagcctgaacgcgctgggtggtgtcggtccgattgtggtgccggatattactattcctggtattccgttgagcctgaacgcgctgggtggtgtcggtccgattgtggtgcctgatattactattcctggtattccgttgagcctgaacgcgctgggtggtgtcggtccgatcaccgttcccggcgtccctatttcccgcatcccccttacgattaacatcaggataccggtcaacatcactctcaacgaacttccgtttaacgtcgctggtatcttcacgggctacatcggccccatcccgcttagcacattcgtattaggcgtcacgctggccggcggcaccctggagtctggcatccagggattcagtgttaatccgttcggtttgaatattccgctgagcggtgctaccaacgctgtcacgatccctggtttcgcgattaatccgtttgggttgaatgttccgttgagcgggggcacgagcccggttacgatccctggtttcgcgattaatccgtttgggttgaatgttccgttgagcgggggcacgagcccggttacgatccccggcttcaccattcccggatcccccctgaacttgaccgccaacggcggcttgggaccgatcaacatcccgatcaacatcacgagcgccccgggcttcggaaactccaccaccaccccgtcttcgggcttcttcaacagtggcgatggaagcgcatccggcttcggcaacgtcgggcccggcatttcgggcctctggaaccaggtgccgaacgcgctgcaaggcggagtctcgggaatctacaacgtcgggcagctggcgtcgggcgtggcgaacctaggcaacaccgtctcgggcttcaacaacacgagcaccgttggtcacctcaccgctgcgtttaactcgggcgtcaacaacatcggccaaatgctcctgggcttcttctcaccgggtgccgggccg

SEQ ID NO: 131 - protein, 171 aa, Mycobacterium tuberculosis
VSCTFDMVPETVDHLDEVGLRRVFGCFPCGVIAVCAMVDDQPVGMAASSFTSVSVDPPLVSICVQNCSTTWPKLRDRPRLGVSVLAEGHDAACMSLSRKEGNRFAGVFWSELSSGGVVIAGAGAWLDCRPYAEIPAGDHLIALLEICAVRADPETPPLVFHGSRFRRLESR

SEQ ID NO: 132 - DNA, 513 bp, Mycobacterium tuberculosis
gtgagctgcaccttcgacatggtcccggagaccgtcgatcatctcgacgaggtcgggctgcggcgggtcttcggctgctttccgtgcggcgtgatcgccgtctgcgcgatggtcgacgaccagccggtcggcatggcggccagctcgttcacgtcggtttcagttgacccgccgctggtatcgatctgtgtgcagaactgttcgacgacgtggccgaagttgcgcgaccgcccacggctcggtgtgagcgtgctcgccgaggggcacgacgcggcctgtatgagcctgtcgcgcaaggaaggtaaccggttcgccggggtgttctggagcgaattgtccagcgggggtgtggtgatcgccggggccggcgcctggctggattgccgcccgtacgcggagatcccggcgggggatcacctgatcgccctgctggagatctgcgcggtgcgcgccgatcccgagacaccgccgctggtgtttcacggtagccggttccgccggttggagtctcga

SEQ ID NO: 133 - protein, 233 aa, Mycobacterium tuberculosis
AAQTTTLPDEPRNGVTGGIDWARDDHAASIVDARGREVRRATIEHNAAGLRELLELLSRAGAREVAIERPDGPVVDTLLEAGITVVVISPNQLKNLRGRYGSAGNKDDRFDAFVLADTLRTDRSRLRPLLPDTPATATLRRTCRPRKDLVAHRVALANQLRAHLRVVFPGVVGLFADLDSPISLAFLTFLPRFDCQDRADWLSVKRLAGWLAAAGYCGRAPRPAHRCPARRHR

SEQ ID NO: 134 - DNA, 699 bp, Mycobacterium tuberculosis
gcggcccaaaccactaccctgcccgacgagccgcggaacggcgtcacgggtggaatcgattgggcgcgagatgatcacgcggcgtcgatcgtcgatgcgcgtgggcgcgaggttcgccgcgccacgatcgagcacaacgccgccggactgcgcgagctgctcgagctgctgagccgggccggtgcccgcgaggtcgccatcgaacgcccggacggcccggtcgtggataccctgctcgaggccgggatcacggtggtggtgatcagccccaaccagctgaagaatctgcgcggtcgttacggctcggctggcaacaaggacgaccggttcgacgcgttcgtgctcgccgacacgttgcgcaccgaccggtcccggctgcgccccctgctgcccgacaccccggccacggccaccctgcgccggacctgccgcccccgcaaagacctcgtcgcccaccgggttgcgttggccaatcagctgcgcgcgcacctgcgcgtcgtctttccgggtgtggtcgggttgttcgctgaccttgactcgccgatcagcctcgcgtttttgacgtttttgccccgtttcgactgccaggaccgcgcggactggctgtcggtcaagcgcctggccggctggctggccgccgctggctactgcggccgtgctccacgaccggctcaccggtgccccgcgcggcgccaccgg

SEQ ID NO: 135 - protein, 573 aa, Mycobacterium tuberculosis
VTHPDRANVNPGSPPLRETLSQLRLRELLLEVQDRIEQIVEGRDRLDGLIDAILAITSGLKLDATLRAIVHTAAELVDARYGALGVRGYDHRLVEFVYEGIDEETRHLIGSLPEGRGVLGALIEEPKPIRLDDISRHPASVGFPLHHPPMRTFLGVPVRIRDEVFGNLYLTEKADGQPFSDDDEVLVQALAAAAGIAVDNARLFEESRTREAWIEATRDIGTQMLAGADPAMVFRLIAEEALTLMAGAATLVAVPLDDEAPACEVDDLVIVEVAGEISPAVKQMTVAVSGTSIGGVFHDRTPRRFDRLDLAVDGPVEPGPALVLPLRAADTVAGVLVALRSADEQPFSDKQLDMMAAFADQAALAWRLATAQRQMREVEILTDRDRIARDLHDHVIQRLFAVGLTLQGAAPRARVPAVRESIYSSIDDLQEIIQEIRSAIFDLHAGPSRATGLRHRLDKVIDQLAIPALHTTVQYTGPLSVVDTVLANHAEAVLREAVSNAVRHANATSLAINVSVEDDVRVEVVDDGVGISGDITESGLRNLRQRADDAGGEFTVENMPTGGTLLRWSAPLR

SEQ ID NO: 136 - DNA, 1719 bp, Mycobacterium tuberculosis
gtgacacaccctgacagggcgaacgttaaccctggcagcccgccattgcgcgagacactgtcgcagcttcggttgcgagagctgctgctggaagtccaagaccggattgaacagatcgtcgaaggccgcgaccggctggatggtctgatcgacgccatcttggcgatcacatcgggactcaagctcgacgccaccctgcgcgccattgtgcataccgccgccgagttggtggatgcccgctacggggcgctcggggtgcgcggttacgaccatagattggtcgaattcgtctacgaggggatcgacgaagagacccggcacctcatcggctcattgccggaggggcgaggtgttctcggcgcgctgatcgaggagccaaagccgatccggctggacgatatctcgcggcatcccgcatcggttggatttccgctgcaccatccgccgatgcggaccttcctcggggttccagtgcgcatccgcgacgaggtgttcggcaatctttacttgaccgagaaggcagatggccagccgttcagcgatgacgacgaggtgctggtgcaggcgctggccgccgcggccgggattgccgttgacaatgcccgtctcttcgaggaatcacggacccgggaagcgtggatcgaggcaacccgcgacatcggaacgcagatgctggccggtgcggacccggccatggtgtttcggctcatcgccgaggaagcgttgacgttgatggctggggcagccaccttggtggcggtgccgctcgacgacgaagcgccggcttgcgaggtcgacgacctggtcatcgtagaggtggccggagagatctccccggcggtcaagcaaatgacggttgccgtcagcggaacgtcgatcgggggagtctttcacgaccgtacgccccgccggttcgaccggcttgacctcgcggtcgacggcccggtggagcccgggcccgccctggtgctgccgctgcgtgccgccgacactgttgccggtgtgctggtcgcacttcgcagtgccgatgaacagccgttcagcgacaaacagctcgatatgatggccgccttcgctgaccaggctgcgctcgcctggcggctggcgaccgcgcagcgacagatgcgagaagtggagatcctgaccgatcgcgaccggatcgcacgtgatctgcatgaccacgtcatccagcggctcttcgcagtcgggctcaccctgcagggtgccgctccgcgagcacgtgtccccgccgtccgggaatccatctacagcagcatcgacgatctccaggaaatcattcaggagattcgatctgcgatcttcgacctacacgccgggccctcccgggcgacgggtctgcgccaccgactggacaaggtcatcgaccaactcgcgatccccgcgctgcacaccacggtccagtacacgggcccgctgtccgttgtcgacaccgtcctggccaaccacgccgaagcggttctgcgggaggcggttagcaacgctgtccggcacgcgaacgcgaccagcctggccatcaacgtcagcgtcgaggatgatgtgcgggtcgaggtcgtcgacgacggtgtcggcatctccggcgacatcaccgaaagcggcctgcgcaatctccgccagcgtgccgacgacgcgggcggcgaattcacagtcgagaacatgccgaccggaggcaccttgctgcggtggtctgcaccgctgcgc

SEQ ID NO: 137 - protein, 217 aa, Mycobacterium tuberculosis
ANHRNTQGRNEFLRAEVRPATPLICAFGDKHKHTYGVTPICRALAVHGVQIASRTYFADRAAAPSKRALWDTTITEILAGYYEPDAEGKRPPECLYGSLKMWAHLQRQGFRWPSATVKTIMRANGWRGVPLAAHITHHRTRPGRGPGPRPGGSAMAGFSNEPAGSGRLHLRADDVEFRLHRVRGRRLRRCDRGLGMLADQRRSVRRTRITPRPSRLT

SEQ ID NO: 138 - DNA, 651 bp, Mycobacterium tuberculosis
gcaaaccatcgaaatactcaaggtcgcaacgagtttcttcgcgcggaagtgcgacccgcgacaccgctgatctgtgcgttcggcgacaagcacaagcacacctacggggtcacaccgatctgtcgggcactggccgtgcacggcgtgcagatcgcctcgcgcacctatttcgcggatcgcgcggcagcgccttcgaaacgcgcactgtgggacaccacaatcaccgaaatcctggccggctactacgaacccgacgccgagggcaaacgcccaccggaatgcctgtacggcagcctgaagatgtgggcgcacctgcagcgccagggcttccggtggccctctgccacggtgaagacgatcatgcgggccaacggttggcgcggagtgcccctcgcagcgcacatcacacaccaccgaaccagacccggccgcggcccaggccctagacctggcgggtcggcaatggcgggctttagcaacgaacctgctggaagcggccgacttcacctacgcgccgatgacgtggagttccggctacaccgcgttcgtggtcgacgcctacgccggtgtgatcgcgggctgggaatgctcgctgaccaaagacgcagcgttcgtcgaacgcgcattacgccacggccttccagactcacc

SEQ ID NO: 139 - protein, 121 aa, Mycobacterium tuberculosis
PKTQRSSNAHYATAFQTHLGHPFGGAIHHRDAGSQYTAIYFGKTPMLAGLRPSIGIVGDALDNALCETTTGPHRTECSHGSPFRSGPIRTLADLEDIASAWVEHTCHTQQGVRIPGRLQPA

SEQ ID NO: 140 - DNA, 363 bp, Mycobacterium tuberculosis
ccaaagacgcagcgttcgtcgaacgcgcattacgccacggccttccagactcacctaggtcacccgtttggcggagctattcatcatcgcgacgccggaagtcagtatactgcaatatatttcggcaagacaccgatgctagccgggctgcggccgtcgataggcattgttggcgacgccctcgacaacgccttatgtgaaaccacgacagggccccacaggaccgaatgcagccacggcagcccgtttcgtagcgggccgatccgcaccctggctgacctggaagacatcgcctcggcgtgggtggagcacacctgtcacacacaacaaggtgtgcgaatacccgggaggcttcaacctgcg

SEQ ID NO: 141 - protein, 375 aa, Mycobacterium tuberculosis
MGSRRFDAEVYARRLALAAAATADAGLAGLVITPGYDLCYLIGSRAETFERLTALVLPAAGAPAVVLPRLELAALKQSAAAELGLRVCDWVDGDDPYGLVSAVLGGAPVATAVTDSMPALHMLPLADALGVLPVLATDVLRRLRMVKEETEIDALRKAGAAIDRVHARVPEFLVPGRTEADVAADIAEAIVAEGHSEVAFVIVGSGPHGADPHHGYSDRELREGDIVVVDIGGTYGPGYHSDSTRTYSIGEPDSDVAQSYSMLQRAQRAAFEAIRPGVTAEQVDAAARDVLAEAGLAEYFVHRTGHGIGLCVHEEPYIVAGNDLVLVPGMAFSIEPGIYFPGRWGARIEDIVIVTEDGAVSVNNCPHELIVVPVS

SEQ ID NO: 142 - DNA, 1125 bp, Mycobacterium tuberculosis
atgggttctcgccgattcgacgccgaggtttatgcacggcggctggctttagcggcggccgcgacggcggacgccggtctggcgggtctggtgataactcccggctacgacctgtgttacctcatcgggtcgcgagcggagacgttcgagcggctcaccgcgttggtgttgccggccgccggtgcgccggcggttgtgctgccgcggctggagctcgccgccctcaagcaatccgccgcagcggaattgggtctgcgcgtgtgcgattgggtcgacggtgacgacccctacgggttggtgagtgccgtgttgggcggagctccggtagcgaccgcggtcaccgattccatgccggcgttgcacatgttgccgctggccgacgcactgggtgtgctgccggtattggccaccgacgtgctgcgcaggctgcggatggtcaaggaggaaaccgagatcgacgcgctgcgtaaggccggcgcggcgatcgatcgagtgcatgcccgagtgccggagtttctggtcccgggccgaacggaagccgacgtagccgccgacatcgccgaagcaattgtcgccgaagggcattcggaggtagcgttcgtcatcgtgggttccgggccgcacggcgccgacccgcatcacggatattcggaccgcgaattgcgggagggtgacatcgttgtcgtcgacatcggcggcacgtatgggcctggataccactccgactccacccgaacctacagcatcggcgagcctgattctgatgtagcgcagtcatattcgatgttgcagcgagcccagcgggcggcgttcgaggccatccgcccaggggtgacagcggagcaggtggacgccgccgcgcgtgacgtgctcgccgaggccgggctcgcggagtattttgtgcaccgcaccgggcacggcatcgggctgtgcgtgcacgaggagccctatatcgtcgccggcaatgacctggtgttggttcccggcatggcgttttccatcgagccgggaatctatttcccgggccggtggggcgcccgcatcgaggacatcgtgatcgtgaccgaggacggtgctgtgtctgtcaacaactgcccgcacgagttgatcgtggtgccggtgtcc

SEQ ID NO: 143 - protein, 244 aa, Mycobacterium tuberculosis
MSGPQGSDPRQPWQPPGQGADHSSDPTVAAGYPWQQQPTQEATWQAPAYTPQYQQPADPAYPQQYPQPTPGYAQPEQFGAQPTQLGVPGQYGQYQQPGQYGQPGQYGQPGQYAPPGQYPGQYGPYGQSGQGSKRSVAVIGGVIAVMAVLFIGAVLILGFWAPGFFVTTKLDVIKAQAGVQQVLTDETTGYGAKNVKDVKCNNGSDPTVKKGATFECTVSIDGTSKRVTVTFQDNKGTYEVGRPQ

SEQ ID NO: 144 - DNA, 732 bp, Mycobacterium tuberculosis
atgagcggaccgcagggatcggacccaaggcagccgtggcagccgcccggccagggcgccgaccattcctcggaccccaccgtggccgcgggatatccctggcagcagcagccgacccaggaggcgacgtggcaggccccggcgtacacaccgcagtaccaacagccggctgacccggcgtacccgcagcagtacccgcagcccacacccggctatgcgcagcccgaacagttcggtgcacagcccacccagctcggcgtgcccggtcagtacggccaataccagcagccgggccaatatggccagccgggacagtacggccagcccggccagtacgcaccgcccggtcagtaccccgggcaatacggcccgtatggccagtcgggtcaggggtcgaagcgttcggttgcggtgatcggcggcgtgatcgccgtgatggccgtgctgttcatcggcgcggttctaatactcggcttctgggcacccggattcttcgtcaccaccaagctggacgtcattaaggcgcaggccggtgtgcagcaggttctcaccgatgagaccacggggtacggcgccaagaacgtcaaagacgtcaagtgcaacaacggttcagaccccacggtcaaaaagggcgccaccttcgaatgcacggtgagcatcgacggcacctcaaagcgcgtgaccgtgaccttccaggacaacaagggcacctacgaggtcggccggccacag

SEQ ID NO: 145 - protein, 308 aa, Mycobacterium tuberculosis
VRAAGLLKRLNPRNRRSRVNPDATMSLVDHLTELRTRLLISLAAILVTTIFGFVWYSHSIFGLDSLGEWLRHPYCALPQSARADISADGECRLLATAPFDQFMLRLKVGMAAGIVLACPVWFYQLWAFITPGLYQRERRFAVAFVIPAAVLFVAGAVLAYLVLSKALGFLLTVGSDVQVTALSGDRYFGFLLNLLVVFGVSFEFPLLIVMLNLAGLLTYERLKSWRRGLIFAMFVFAAIFTPGSDPFSMTALGAALTVLLELAIQIARVHDKRKAKREAAIPDDEASVIDPPSPVPAPSVIGSHDDVT

SEQ ID NO: 146 - DNA, 924 bp, Mycobacterium tuberculosis
gtgcgcgccgccggtcttctcaaacggctcaacccacgtaacaggcgcagccgcgtcaatcctgacgcgacgatgtcgctggtcgaccacctgaccgagttacgcaccaggttgctgatctccctggccgcgatcttggtcaccacaatcttcgggttcgtctggtattcgcattcgattttcgggttggacagcctcggagagtggctgcggcatccctactgtgccctgccgcagtcggcccgggcggatatcagcgccgacggagagtgccgtttgttggccaccgcgccgttcgaccagttcatgttgcggctcaaggtcgggatggccgccggcattgtgctggcttgcccggtgtggttctaccagctgtgggcgttcatcacgcctggtctctaccagagggagcgccgcttcgcggtggccttcgtgatcccagcagcggtgctgttcgtcgccggtgccgtactggcctacctggtgttgtccaaggcgttgggctttttgttgaccgtcggcagcgacgtgcaggtgaccgcgctgtctggcgaccgctactttggctttctgctcaacctgctggtggtgttcggggtcagcttcgaattccccctgctgatcgtgatgctgaacctggcgggcctgctgacctatgagcggctcaagtcttggcggcgcgggttgatctttgcgatgttcgtcttcgcggcgatcttcacgcccggatccgatccgttctcgatgaccgcgctcggtgcggcgttgaccgtgctgctagagctcgccattcagatcgcccgcgtgcatgacaagcgaaaagccaagcgcgaagccgcgattcccgacgacgaagcttcggtcatcgacccgccctcgccggtgccggcgccatcggtcatcggatctcatgacgacgtcacg

SEQ ID NO: 147 - protein, 108 aa, Mycobacterium tuberculosis; identical to SEQ ID NO: 61

SEQ ID NO: 148 - DNA, 324 bp, Mycobacterium tuberculosis; identical to SEQ ID NO: 62

SEQ ID NO: 149 - protein, 108 aa, Mycobacterium tuberculosis; identical to SEQ ID NO: 61

SEQ ID NO: 150 - DNA, 324 bp, Mycobacterium tuberculosis; identical to SEQ ID NO: 62

SEQ ID NO: 151 - protein, 414 aa, Mycobacterium tuberculosis
VNDNQLAPVARPRSPLELLDTVPDSLLRRLKQYSGRLATEAVSAMQERLPFFADLEASQRASVALVVQTAVVNFVEWMHDPHSDVGYTAQAFELVPQDLTRRIALRQTVDMVRVTMEFFEEVVPLLARSEEQLTALTVGILKYSRDLAFTAATAYADAAEARGTWDSRMEASVVDAVVRGDTGPELLSRAAALNWDTTAPATVLVGTPAPGPNGSNSDGDSERASQDVRDTAARHGRAALTDVHGTWLVAIVSGQLSPTEKFLKDLLAAFADAPVVIGPTAPMLTAAHRSASEAISGMNAVAGWRGAPRPVLARELLPERALMGDASAIVALHTDVMRPLADAGPTLIETLDAYLDCGGAIEACARKLFVHPNTVRYRLKRITDFTGRDPTQPRDAYVLRVAATVGQLNYPTPH

SEQ ID NO: 152 - DNA, 1242 bp, Mycobacterium tuberculosis
gtgaacgacaatcagttggctccagttgcccgcccgaggtcgccgctcgaactgctggacactgtgcccgattcgctgctgcggcggttgaagcagtactcgggccggctggccaccgaggcagtttcggccatgcaagaacggttgccgttcttcgccgacctagaagcgtcccagcgcgccagcgtggcgctggtggtgcagacggccgtggtcaacttcgtcgaatggatgcacgacccgcacagtgacgtcggctataccgcgcaggcattcgagctggtgccccaggatctgacgcgacggatcgcgctgcgccagaccgtggacatggtgcgggtcaccatggagttcttcgaagaagtcgtgcccctgctcgcccgttccgaagagcagttgaccgccctcacggtgggcattttgaaatacagccgcgacctggcattcaccgccgccacggcctacgccgatgcggccgaggcacgaggcacctgggacagccggatggaggccagcgtggtggacgcggtggtacgcggcgacaccggtcccgagctgctgtcccgggcggccgcgctgaattgggacaccaccgcgccggcgaccgtactggtgggaactccggcgcccggtccaaatggctccaacagcgacggcgacagcgagcgggccagccaggatgtccgcgacaccgcggctcgccacggccgcgctgcgctgaccgacgtgcacggcacctggctggtggcgatcgtctccggccagctgtcgccaaccgagaagttcctcaaagacctgctggcagcattcgccgacgccccggtggtcatcggccccacggcgcccatgctgaccgcggcgcaccgcagcgctagcgaggcgatctccgggatgaacgccgtcgccggctggcgcggagcgccgcggcccgtgctggctagggaacttttgcccgaacgcgccctgatgggcgacgcctcggcgatcgtggccctgcataccgacgtgatgcggcccctagccgatgccggaccgacgctcatcgagacgctagacgcatatctggattgtggcggcgcgattgaagcttgtgccagaaagttgttcgttcatccaaacacagtgcggtaccggctcaagcggatcaccgacttcaccgggcgcgatcccacccagccacgcgatgcctatgtccttcgggtggcggccaccgtgggtcaactcaactatccgacgccgcac

SEQ ID NO: 153 - protein, 312 aa, Mycobacterium tuberculosis
MPLSSRMPGLTCFEIFLAIAEAGSLGGAARELGLTQQAVSRRLASMEAQIGVRLAIRTTRGSQLTPAGIVVAEWAARLLEVADEIDAGLGSLRTEGRQRIRVVASQTIAEQLMPHWMLSLRAADMRRGGTVPEVILTATNSEHAIAAVRDGIADLGFIENPCPPTGLGSVVVARDELVVVVPPGHKWARRSRVVSARELAQTPLVTREPNSGIRDSLTAALRDTLGEDMQQAPPVLELSSAAAVRAAVLAGAGPAAMSRLAIADDLAFGRLLAVDIPALNLRRQLRAIWVGGRTPPAGAIRDLLSHITSRST

SEQ ID NO: 154 - DNA, 936 bp, Mycobacterium tuberculosis
atgccgctcagctctcgtatgcccggactcacctgcttcgaaatctttctggccatcgctgaggccggcagtcttggcggcgccgcacgcgaactcgggttgactcaacaagctgtgtcaaggcggctcgcatcgatggaggcccagatcggggtgcgattggccatccggacgacacgtggctcccaactcacgcctgccggcatcgtcgtcgccgaatgggcggcccgcttgctcgaagtcgccgacgagatcgatgccggcctcggctcgctgcgcaccgaaggccgccagcgcatcagagtggtggccagccagacgatagccgaacagctgatgccgcattggatgctgtccttgcgggccgccgacatgcgccgcggtggtactgtccctgaggtaatcctgaccgccaccaatagcgagcatgcgatcgcagccgttcgtgacggcatcgcagatcttggattcatcgaaaacccctgtcctcccacgggattaggcagcgttgtggttgcacgcgacgaactggtcgtcgtcgtgccgccgggtcacaagtgggcccgacggtcacgagtagtgagcgcccgggagctcgctcagacgcctttggtgactcgcgaaccgaactctggcatccgcgattcactcaccgcggcgttacgtgacacgctcggggaggacatgcagcaagcgccaccggtgctggaattatcatcggctgcggccgtgcgggccgcggtcttggccggcgctggaccggctgcgatgagccggctagcgatagccgatgacctggcgttcggtcgattactcgcggtcgacatccccgcgttgaacctgcggcgccagcttcgagccatctgggtcggtgggcgcaccccgccggcgggtgcgatacgagacctgctcagccacatcacttcccgcagcacg

SEQ ID NO: 155 - protein, 74 aa, Mycobacterium tuberculosis
VNPGFDAVDQETAAAQAVADAHGVPFLGIRGMSDGPGDPLHLPGFPVQFFVYKQIAANNAARVTEAFLQNWAGV

SEQ ID NO: 156 - DNA, 222 bp, Mycobacterium tuberculosis
gtgaaccccggcttcgacgcggttgaccaggagacggcagccgcgcaggcggtcgccgatgcacacggcgtcccgttcctgggaattcgcggtatgtccgacgggcccggcgacccgctgcatctgccgggcttccccgtccagttcttcgtttacaagcagattgcggccaacaacgccgcccgggtcaccgaagccttcctgcagaactgggccggcgtc

SEQ ID NO: 157 - protein, 114 aa, Mycobacterium tuberculosis
VVAALHAGKAVTIAPQSMTLTTQQAADLLGVSRPTVVRLIKSGELAAERIGNRHRLVLDDVLAYREARRQRQYDALAESAMDIDADEDPEVICEQLREARRVVAARRRTERRRA

SEQ ID NO: 158 - DNA, 342 bp, Mycobacterium tuberculosis
gtggtggctgcgctgcacgccggcaaggcggtgaccatcgcgccgcagagcatgacgctgaccacccagcaggccgccgaccttctcggggtgagtcgtccgaccgtggtgcgtctgatcaagagcggcgagctggccgccgagcgcatcgggaatcgccaccggctcgtgctcgacgacgtgttggcctaccgggaggcccgccggcagcgccagtacgacgcgcttgccgagagcgcaatggacatcgacgccgacgaggatcccgaggtgatttgcgagcagttgcgtgaggcgcggcgtgttgtcgccgcgcgccgtagaactgagcggcggcgcgcc

SEQ ID NO: 159 - protein, 221 aa, Mycobacterium tuberculosis
MTNLADATQATMALVERHAAHNYSPLPVVAASAEGAWIADIDGLRYLDWLAAYSAVNLGHRNPASTATAHAQVDTVTLLNRALHADRLGPLGAALAQLCGKDVVLPMNSDAEAVESGLRVARKWGADVNGLPAGRHDIILANNNFHGHTSSVVSFSSDPAAGSGVEPSTPGLRSVPFGDAAAPAQTIDDNTVADLLEPIPGQAGIIVPADDYLPAASSTTC

SEQ ID NO: 160 - DNA, 663 bp, Mycobacterium tuberculosis
atgacaaatctcgcggatgccactcaggccactatggcactggtcgaaaggcatgcagcgcacaattattcgccgctgcctgtggtggcggccagcgctgagggtgcgtggatcgccgatatcgacggcctgcgctacctggactggctggctgcgtactcggcggtcaaccttggccatcgcaaccccgcgagcaccgccacggctcatgcccaagtcgacaccgtcaccctgctgaatcgggccttgcatgccgaccgactcgggccgttgggcgccgcgcttgcccagctgtgcggcaaagacgtggtgttgccaatgaactctgatgctgaagcggtggagagcggtcttagggtcgcccgcaagtggggagccgacgtcaacggcctccccgcgggccggcacgatatcattttggcaaacaacaactttcatggccacaccagcagtgtcgtcagcttctcgtcggacccggctgcgggcagcggcgtcgaaccttctaccccgggactccgctcggtaccgtttggcgatgctgcggcaccggcgcagacaatcgacgacaacaccgtcgctgacctgctcgagccgattcccggccaggcgggcatcatcgtcccggccgacgactacctgccggctgcgtcgagcacaacgtgc

SEQ ID NO: 161 - protein, 302 aa, Mycobacterium tuberculosis
MENTQRPSFDCEIRAKYRWFMTDSYVAAARLGSPARRTPRTRRYAMTPPAFFAVAYAINPWMDVTAPVDVQVAQAQWEHLHQTYLRLGHSVDLIEPISGLPDMVYTANGGFIAHDIAVVARFRFPERAGESRAYASWMSSVGYRPVTTRHVNEGQGDLLMVGERVLAGYGFRTDQRAHAEIAAVLGLPVVSLELVDPRFYHLDTALAVLDDHTIAYYPPAFSTAAQEQLSALFPDAIVVGSADAFVFGLNAVSDGLNVVLPVAAMGFAAQLRAAGFEPVGVDLSELLKGGGSVKCCTLEIHP

SEQ ID NO: 162 - DNA, 906 bp, Mycobacterium tuberculosis
atggaaaatacgcaacgaccatcgtttgattgtgaaatcagagccaaatatcgttggtttatgacggattcctacgtcgctgctgcccgtctagggtcacctgcacgccgcaccccccggacgcggcggtatgcaatgaccccgccggccttctttgccgtcgcatacgcgatcaacccctggatggacgtcaccgcgccagtcgacgtccaagtcgcgcaagcacagtgggagcacctccaccagacctatcttcggctaggccacagcgtggatctgatcgagcccatttccgggttaccggacatggtgtacaccgccaacggtgggttcatcgcgcacgacatcgccgtggtcgcccggttccggttccccgaacgagctggtgagtctagagcctatgccagctggatgtcctcggtcggatatcgcccggtgaccacccgccacgtcaacgagggacagggcgacctgctgatggttggcgaaagggtgttggcgggctacggctttcgcacagaccagcgcgcacacgccgaaatcgccgcggtgcttggtctgccggtggtctccctcgagttggtcgacccacggttctatcacctggacaccgcgctggccgtgctcgacgaccacacgatcgcctactacccgccggcgttcagtacggcagcgcaggaacagttgtcggcgctgttccccgacgcgattgtggtcggcagtgccgacgcgttcgtgttcggactcaacgccgtctctgacggtctgaacgtagtgcttccggtcgcggccatgggttttgcggcgcagttacgcgcagccggcttcgagccggtcggtgtcgatctgtccgagctgctcaagggcggcggttccgtcaagtgctgcacgctggagatacaccca

SEQ ID NO: 163 - protein, 652 aa, Mycobacterium tuberculosis
MVESGTGIPLPASCWSRTRSRRCMPKDSSPHWIWHSSAARAALYVRGKRRPDGQGRRSCALRNRGRTPATGPGPGQSPSPVGARQPALPSRRPLNPARSRTEVVMSDARVPRIPAALSAPSLNRGVGFTHAQRRRLGLTGRLPSAVLTLDQQAERVWHQLQSLATELGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPIDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 164 - DNA, 1956 bp, Mycobacterium tuberculosis
atggttgagtcgggaaccgggatccccctaccggcttcctgctggagccggacgagatcgaggcgatgcatgccgaaggattcctcgccgcactggatctggcactcttctgcggccagggcagcgctgtacgttcgcggcaaacgccgacccgatggccaagggcgtcgatcgtgcgctctgcgaaatcgtggccgaacgccggcaactggacctggacctggccaaagcccaagtccggtcggcgctcgccaaccagcgttaccatcgcgacgtccattaaacccagcacggtcacgaacggaggttgtgatgagcgacgcccgcgtgccacggatcccggccgcgttgtccgcaccaagtctcaaccgtggagtcggcttcacccacgcgcagcggcggcggctggggctgaccggccggcttccgtcggccgtgctcacgctcgaccaacaggccgaacgcgtatggcatcagttgcagagcttggccaccgagctgggccgcaacctgcttctcgaacagctgcactaccgccacgaggtgctgtacttcaaggtgctggccgaccatttgcccgaactgatgccggtggtgtacacgcccaccgttggcgaggcaatccaacgcttctccgacgaataccgcgggcaacgcggactgtttctgagcatcgacgaacccgacgaaatcgaggaagccttcaacacgttggggctggggcccgaggacgtcgacctgatcgtgtgcaccgatgccgaggcgatcctgggtatcggtgactggggtgtgggtggcatccagatcgctgtgggcaaattggccctctacaccgccggcggcggcgtcgatccgcgccgctgcctcgcggtgtctctggatgtcggcaccgacaatgagcagctgctggccgatccgttctatctgggcaatcgccacgcccggcggcgcggtcgggaatacgacgagttcgtcagtcgctatatcgaaacggctcaacggttatttccgcgtgccattctgcatttcgaggacttcgggccggcgaacgcgcggaagatcctagacacatacggcacggattactgcgtgttcaacgatgacatgcaaggaaccggcgcggtggtcttggccgccgtatacagcggtctgaaggttaccggtatcccgctgcgcgatcagacaatagtcgtcttcggcgcaggcaccgcagggatggggatcgccgatcagatccgggacgcgatggtggcagacggtgccacgctcgagcaggcggtgtcccagatctggccgatcgacaggccgggcctgttgttcgacgacatggatgacctgcgcgacttccaagtgccgtacgcgaaaaaccgccaccagctcggtgtggccgtcggggatcgggtcgggctgagcgacgcgatcaagatcgcatcgcccactatcctgctcggctgctcaacggtctacggagcgttcaccaaagaggtggtcgaggcgatgacggcgtcctgcaaacacccgatgatctttccgctgtccaacccgacgtcgcgcatggaagccatccccgccgacgtgctggcgtggtcgaatggcagggcgctgcttgccaccggcagcccagtcgccccagtggaattcgacgaaaccacctacgtcatcggtcaggccaacaacgtgttggcgtttcccggcatcggactgggcgtcattgtcgctggtgcccggttgataaccaggcgcatgctgcatgcagcagcgaaggccattgcgcaccaggccaatccgacaaatcccggagactcgctgttgccggatgtccaaaatctgcgggccatctcgacaacggtcgccgaagctgtctatcgggccgccgtccaagacggggtggcttccaggacgcacgacgacgtcaggcaggccatagtcgacaccatgtggctcccggcatatgac

SEQ ID NO: 165 - protein, 356 aa, Mycobacterium tuberculosis
MLSLTLSEASCIASASRWRHIIPAGVVCALIAGIGVGCHGGPSDVVGRAGPDRAHTSITLVAYAVPEPGWSAVIPAFNASEQGRGVQVITSYGASADQSRGVADGKPADLVNFSVEPDIARLVKAGKVDKDWDADATKGIPFGSVVTFVVRAGNPKNIRDWDDLLRPGIEVITPSPLSSGSAKWNLLAPYAAKSDGGRNNQAGIDFVNTLVNEHVKLRPGSGREATDVFVQGSGDVLISYENEAIATERAGKPVQHVTPPQTFKIENPLAVVATSTHLGAATAFRNFQYTVQAQKLWAQAGFRPVDPAVAADFADLFPVPAKLWTIADLGGWGSVDPQLFDKATGSITKIYLRATG

SEQ ID NO: 166 - DNA, 1068 bp, Mycobacterium tuberculosis
atgctctccttgacgctttctgaagcgagctgcatcgctagcgcatcccgctggcggcacattatccctgccggggtggtgtgcgcattgatcgccggtatcggcgtggggtgtcatggcggtcccagcgacgtggtcggccgtgcgggaccggaccgtgcgcatacgagcatcaccctggtcgcctacgccgtcccggaacccggctggagtgcggtgattcccgcgttcaacgcttccgaacagggccggggagtccaggtgattacctcatatggcgcgtcggccgaccagtcgcgcggtgttgccgacggtaaaccggccgacctggtgaacttctcggtcgaaccggacatcgctcgcctggtcaaggccggcaaggttgacaaggactgggacgccgatgccaccaagggcatcccgttcgggtcggtggtgacgtttgtggtccgcgcgggtaacccgaagaacatcagagattgggatgacctgttgcgcccgggtattgaggtcatcacgcccagtccgctgagttcgggttctgccaagtggaatctgctagccccctacgccgcgaaaagtgacggtggccggaataaccaagcggggatcgactttgtcaatacattggtgaatgaacacgtcaaattgcgccccgggtcggggcgggaagccaccgatgtttttgtccagggcagcggtgacgtgttgatcagctacgagaacgaagccatcgccaccgagcgggcgggcaaaccggtgcagcacgtcaccccgccgcagacgttcaagatcgaaaatccgttggccgtagtggcgaccagcacacaccttggagcggcgaccgcattcagaaacttccagtacaccgtgcaggcgcagaagttatgggcgcaggccggtttccggccggtcgatccggcggtcgccgccgattttgccgacctgtttccggtgccggcgaaactgtggacgatcgccgacctcggtggctggggcagcgtggatcctcagctgttcgacaaggcgaccggcagcatcaccaagatttatctgcgggccaccgga

SEQ ID NO: 167 - protein, 514 aa, Mycobacterium tuberculosis
MGFGASRLDVRLVPAALVSWIVTAAGIVWPIGNVCALCCVVVALGGGALWWCVARRSWHAPRLGSISAGLVAVGMVGAGYGLAVALRSEAVDRHPITVAFGTSALVTVTPSESPVSLGRGRLMFRATVQRLRDDETSGRVVVFARALDFGELMVGQPVQFRARISRPARHDLTVAVFNATGRPTVGRAGPVHRAAHIVRHRFAAAVREVLPADQATMLPALVLGDTSTVTALTSREFRAAGLTHLTAVSGANVTIVCAAALVSARLIGPRAAVVCAAVALVAFVILVQPTASVLRAAVMGAIALVGMLSARRRQAIPALSGSVLVLLAAAPHLAVDIGFALSVAATGALVVIAPVWSRRLVDRGCPKVLADALAVAAAAQLVTAPLVAAISGRVSLVAVVANLAVAAVIAPITVLGSVAAVLVVPWPAGAQVLIRFTGPEVWWVLRVAHWASGVPAATVPVAAGLPGVLLVGGATVFTVAQWRWRWFRAAMCKTMAVAVICLLAWSLSGLVGPS

SEQ ID NO: 168 - DNA, 1542 bp, Mycobacterium tuberculosis
atgggcttcggcgcgtcccgtttggacgtacgcctggtcccggcggcgctggtcagctggattgtgacggcggccgggatcgtgtggccgatcggcaacgtgtgtgccttgtgctgcgtcgtggtggccctcggcggcggcgcactgtggtggtgtgtggcgcgccggtcgtggcacgctccgcgactgggttcgatcagcgccggcctggtcgcggtcggtatggtgggcgcggggtacgggcttgcggtcgcgttgcgctccgaggcggtcgatcgccacccaatcaccgtggcatttggcacctccgcgctggtcacggtcacccccagcgagagcccagtgtcgctggggcggggccggttgatgttccgggcgacggttcaacggctgcgggatgacgagacatccggccgggtagtggttttcgcgcgagcgctggacttcggcgagctgatggtcggacagcccgtccagttccgcgcgcgtatcagtcgcccggcgcgtcacgacctgacggtcgcggtgttcaatgcgaccggtcggccgaccgtgggccgtgccggcccggtacaccgcgccgctcacatcgtccgccatcgattcgcggccgcggttcgtgaggtgctgcccgctgaccaggccacgatgttgccggccctggttctcggcgatacctcgacggtcaccgccttaaccagccgcgagttccgtgcggcgggcctgacgcacttgacggcggtctcgggggccaatgtcacgatcgtgtgtgcggcggcgctggtttcggcacggttgatcggaccgcgtgcggccgtggtgtgcgcggccgtcgcgttggtggcattcgtcatcctggtgcagccgacggccagcgtgttgcgggcagctgtgatgggcgccattgccctcgtggggatgctgtctgcgcgccggcggcaggcgattccagctttgtcgggtagcgtgctggttttgctggctgccgctccccatcttgctgtggacatcggcttcgcgctgtccgtggcggccacgggtgcactggtcgtcatcgcgccggtttggtcacgccgcttggtcgaccgcggatgtccgaaggtgctggccgatgccctcgcagtcgcggcggccgcgcagctggtgacggcgccactggtggccgccatctccggccgggtcagtctggtggccgtggtggccaatctggcggtggcggccgtgatcgcgccgatcaccgtgctgggcagcgttgcggccgtgctggtcgtgccgtggccggccggcgcgcaggtgctgatccggttcaccgggcccgaagtgtggtgggtgttgcgcgtggcgcattgggcgtcgggtgtgcccgcggcgaccgttccggtggccgcaggtctgcccggcgtactgctggtcggtggcgccaccgtgttcacggttgcgcagtggcgctggcgctggtttcgcgcggccatgtgcaaaacgatggcggtggccgtcatatgtctgcttgcctggtcgctgtccgggctggtcggcccttcg

SEQ ID NO: 169 - protein, 139 aa, Mycobacterium tuberculosis
VLQRTNVVQPLNTLRMVWIQVAGIIPATAGIAATVYAQLAMGDSWRIGVDEQENTTLVRTGPFKWVRHPIYTAMMAFGLGLLLVTPNLVALAGFILLVATLEVHVRRVEEPYLLRTHSAVYRGYTASVGRFVPGVGLIR

SEQ ID NO: 170 - DNA, 417 bp, Mycobacterium tuberculosis
gtgctgcagcggaccaacgttgtccaaccgctgaatactctgcgcatggtctggattcaggttgccggcataatcccggcgacggccgggatcgcggccacggtttacgcccagcttgcgatgggcgattcgtggcggatcggggtggacgagcaggagaacaccactctggtgcgcaccggcccgtttaaatgggtgcgtcaccccatctacacggccatgatggcgtttggcctcgggctgttgctggtgactccgaatctcgttgccctcgccgggtttatcctgctcgttgccacgctcgaggtgcatgtccgccgcgtcgaagaaccctacctgttgcggacgcacagtgccgtctaccgcggctacaccgccagcgtcggccggttcgtcccgggtgtggggttgatccgc

SEQ ID NO: 171 - protein, 161 aa, Mycobacterium tuberculosis
VVGHIVNDLQRRKVGDQEVVKFRVASNSRRRTSDGGWEPGNSLFITVNCWGRLVTGVGAALGKGAPVIVVGHVYTSEYEDRDGIRRSSLEMRATSVGPDLSRVIVRIEKPAYTGPSAGDLPAATGTGAAGAADAPASAADSVSDVVVDDAITGHNPLPISA

SEQ ID NO: 172 - DNA, 483 bp, Mycobacterium tuberculosis
gtggtcggtcacatcgtcaacgatttgcagcgccgcaaagtcggtgatcaagaggtcgtcaagttccgggtggccagcaattcgcgccggcgcaccagcgacggcggttgggagcccggcaactcgctgtttatcaccgtcaattgctggggaaggctggtcaccggggtgggcgcagcattgggcaagggcgcaccggtgattgtggtgggacacgtgtacaccagtgaatatgaggaccgggacggcattcgtcgctcgtcgctggagatgcgggcgacgtcggtagggccggatttgtcgcgcgtgatcgtgcgcatcgaaaagccggcctacaccggtccaagcgccggtgatctcccggccgccacggggaccggggcggccggtgccgccgacgccccagcgtcggcagccgactcggtttccgatgtcgtggtcgacgacgccatcactggccacaaccccctgcccatatcggct

SEQ ID NO: 173 - protein, 256 aa, Mycobacterium tuberculosis
MAQYDPVLLSVDKHVALITVNDPDRRNAVTDEMSAQLRAAIQRAEGDPDVHAVVVTGAGKAFCAGADLSALGAGVGDPAEPRLLRLYDGFMAVSSCNLPTIAAVNGAAVGAGLNLALAADVRIAGPAALFDARFQKLGLHPGGGATWMLQRAVGPQVARAALLFGMCFDAESAVRHGLALMVADDPVTAALELAAGPAAAPREVVLASKATMRATASPGSLDLEQHELAKRLELGPQAKSVQSPEFAARLAAAQHR

SEQ ID NO: 174 - DNA, 768 bp, Mycobacterium tuberculosis
atggcccaatacgacccggtcttgctcagcgtcgacaagcacgttgcgctcatcacggtcaacgacccggaccgacggaacgccgtcaccgacgagatgtcggcgcagttgcgtgcggcgatccaacgcgccgaaggcgaccccgacgtacacgccgtagtcgtgaccggggcgggcaaggccttctgcgccggggccgacctgagtgcgctgggcgccggggtcggcgatccagccgagccgagattgttacggctctacgacggtttcatggccgtcagtagttgtaatctgcccaccatcgccgcggtcaacggcgcggctgtgggcgccggactcaatctggcgttggccgccgatgtgcgcatcgccggaccggccgcattgttcgacgcccgcttccaaaagctgggactgcatccaggtggcggcgcaacctggatgctgcagcgagcggtgggtccgcaggtcgcccgtgcggccttattgttcggcatgtgcttcgacgccgaatccgctgtgcggcacggcttggcgctaatggttgccgacgatcccgtcaccgcggcgctggagctggccgccgggcccgcagccgccccgcgcgaggtcgtgctggcgagcaaagccaccatgcgcgccacagccagccccggatcgctggaccttgagcaacacgaactcgccaaacgcttagaacttgggccgcaggcgaaatcggtccagtcgcccgagttcgccgctcgcttggctgccgctcaacacagg

SEQ ID NO: 175 - protein, 547 aa, Mycobacterium tuberculosis
VAAAEVVDPNRLSYDRGPSAPSLLESTIGANLAATAARYGHREALVDMVARRRFNYSELLTDVHRLATGLVRAGIGPGDRVGIWAPNRWEWVLVQYATAEIGAILVTINPAYRVREVEYALRQSGVAMVIAVASFKDADYAAMLAEVGPRCPDLADVILLESDRWDALAGAEPDLPALQQTAARLDGSDPVNIQYTSGTTAYPKGVTLSHRNILNNGYLVGELLGYTAQDRICIPVPFYHCFGMVMGNLAATSHGAAMVIPAPGFDPAATLRAVQDERCTSLYGVPTMFIAELGLPDFTDYELGSLRTGIMAGAACPVEVMRKVISRMHMPGVSICYGMTETSPVSTQTRADDSVDRRVGTVGRVGPHLEIKVVDPATGETVPRGVVGEFCTRGYSVMAGYWNDPQKTAEVIDADGWMHTGDLAEMDPSGYVRIAGRIKDLVVRGGENISPREIEELLHTHPDIVDGHVIGVPDAKYGEELMAVVKLRNDAPELTIERLREYCMGRIARFKIPRYLWIVDEFPMTVTGKVRKVEMRQQALEYLRGQQ

SEQ ID NO: 176 - DNA, 1641 bp, Mycobacterium tuberculosis
gtggcagccgcggaagtcgtagaccccaatcggctttcctatgatcgcggtccgagtgcgccatcattgctcgagtcgaccatcggcgccaacctcgcagcgaccgctgccaggtacggacatcgggaagcactcgtggacatggtggcccggcgacggttcaattacagcgaactgctgactgacgtgcaccggctggcgacggggctggtgcgggcggggatcggcccgggcgatcgggtcggcatctgggcgccgaaccggtgggagtgggtgctcgtccagtacgcgaccgctgagatcggcgcgatcctagtgaccataaaccccgcctatcgggtccgcgaagtggagtatgcgcttaggcagtccggtgtcgcgatggtgattgccgtagcgagtttcaaggatgcggactatgccgcgatgctggccgaggttgggccgcgatgccccgatctggccgacgtgattttgctggaaagcgatcgctgggacgcgctggcgggtgccgagcccgatctgcctgcgctgcagcagaccgcggcgaggctagacggcagtgatccggtaaacatccaatacacctccggcacaacggcatacccgaagggtgtcacgctaagccaccgcaatatcctcaacaacggctacctggtgggcgagctgctcgggtacaccgcacaagatcggatttgcatcccggtgcccttctaccactgcttcggcatggtaatgggaaatctggcggccaccagtcacggggcggccatggtgatcccggcgccgggctttgaccctgcggccacgctgcgcgcggtgcaggacgagcgatgcaccagcttgtacggcgtgccgacgatgttcatcgccgagctgggcctgccggacttcaccgactacgaactgggcagtctgcgcaccgggattatggccggcgccgcgtgcccggtcgaggtgatgcgcaaggtgatctcacgcatgcatatgcccggggtctcgatctgctatggaatgaccgaaacgtcaccggtttccacgcagacgcgcgccgacgactcggtggatcgacgggtcggcacggtcggtcgggtgggtccacaccttgagatcaaggtggtggatccggccacgggcgagacggtcccgcgcggggtggtcggcgagttctgcacgcgaggctattcggtgatggccgggtactggaatgacccgcagaagactgcggaggtgatcgacgccgacggctggatgcacaccggagatctggctgagatggacccgtccgggtacgtgcggatcgccggccggatcaaagacctcgtcgtccggggcggcgagaacatctcgccgcgggagatcgaggaactcctccacacgcatcccgatattgtcgacggtcacgtcatcggggtgcccgacgccaaatacggcgaagagctcatggcggtggtcaagctgagaaacgacgcgccggaactgaccatcgagcggctgcgcgagtactgcatgggccgcatcgcgcgattcaagatcccgcggtacctgtggatcgtcgacgagttcccgatgaccgtcaccggcaaagtacgcaaagtggagatgcgacaacaggcgctcgaatacctccgcggccaacag

SEQ ID NO: 177 - protein, 463 aa, Mycobacterium tuberculosis
VHLAHRVASSRDTPSSSATPNAVSGSASNAADRPCLVRPPTAPPWAHGPRLRRDPTGGGSTPSIVLSRSTDRSKDGHRIVPAGARKSGVRASTGRLPSTRKTTRSPDCRPSASRTAFGTVTCPFDVTMGSSECLLHRCRTPPVPSHSVELLVAANPAEDSRLPYLIRLPVGAGLVFATSDVWPRTKALYCHRLDIADWPADPVVVDRVELRSCSRRGAAIDVVAARARENRSQLVHTMARGRQVVFWQSPKTRKQSRPGVRTPTARAAGIPELHIVVDAHERYPYTFADKPAKTTREALPCGDYGLKVAGQLVAAVERKALADLTSGVLNGNLKYQLTELAALPRAAVVVEDRYSEIFAHSFARPTAIADGLAELQIGFPNVPIVFCQTRKLAQEYTYRYLAAALTWFVDDADATTVFEPAAAEPEPSSAELRAWAKSVGLPVSDRGRLRPQILQAWRAAHPR

SEQ ID NO: 178 - DNA, 1389 bp, Mycobacterium tuberculosis
gtgcacctcgcgcaccgggtcgccagcagccgcgacacgccgtcgtccagtgccacaccgaatgcggtgtcgggctcggcgtcaaacgctgccgatcggccttgcctcgtcaggccgccgacagcaccgccctgggctcacggtccgcggctccgccgggatccgaccggcggcggctcaaccccctcgatcgtcttgagccggtcgacagaccgatcgaaagacggccaccggatcgtcccggcaggggcgaggaagtccggcgtccgagcaagcaccgggcgattgccctcaacgcggaagacaacccgatcacccgattgcaggccgagcgcgtcgcgcaccgctttcggaaccgtcacctgccccttcgacgtgacgatgggttcgtcggagtgcctgcttcaccgttgccgtacgccgcccgtaccctcacactctgtggagctgctcgtcgccgccaaccccgctgaagactcgcgcctgccctacctgatccggctgccggtgggcgcgggactggtcttcgccacctcagacgtgtggccgcgcaccaaggcgctgtattgccatcgcctcgacatcgccgactggcccgccgaccccgtcgtcgtcgaccgggtcgagctacgcagctgcagccgccggggcgcggccatcgacgtcgtcgccgcccgcgcgcgggagaaccgatcgcaactggtgcacaccatggcgcgcggccgccaggtggtgttctggcagagccccaaaacgcgcaaacagtcgcggccgggcgtgcgcacccccaccgcccgcgccgccggcatccccgagctgcacatcgtcgtcgacgcccacgaacgctacccctacacctttgccgacaaacccgcgaagacgacgcgggaagccctgccctgcggcgactacggcctgaaagtggccggccaactcgtggcggccgtcgagcgtaaagcgttggcggaccttacttctggcgtgctgaacggcaacctgaaataccaactgaccgaactggccgcgctgccacgggccgccgtggtggtcgaggaccgctactcggagatcttcgcgcactccttcgcccgcccgacggcgatcgccgatgggctggccgaattgcagatcggctttcccaacgtgccgatcgtgttctgccaaacccgcaagctcgcccaggaatacacctaccgctatctagccgccgccctcacctggttcgtcgacgatgccgacgccaccacggttttcgagccggctgccgccgagcccgagcccagcagcgccgagctgcgcgcgtgggccaaaagcgtcggcctgccggtgtccgaccgggggcgcctgcgcccgcagatcctgcaggcctggcgagccgcccatccccgg

SEQ ID NO: 179 - protein, 134 aa, Mycobacterium tuberculosis
VIAPDTSVLVAGFATWHEGHEAAVRALNRGVHLIAHAAVETYSVLTRLPPPHRIAPVAVHAYLADITSSNYLALDACSYRGLTDHLAEHDVTGGATYDALVGFTAKAAGAKLLTRDLRAVETYERLRVEVELVT

SEQ ID NO: 180 - DNA, 402 bp, Mycobacterium tuberculosis
gtgatcgcaccagacaccagcgtgctggttgccggattcgcgacctggcacgaagggcacgaggccgccgtgcgcgcgctcaaccgtggcgtccatctgatcgcgcacgcggctgtggaaacctattcggtcttgacccggctaccaccgccgcatcgtattgcccctgttgccgtccacgcctacttggcggacatcacctccagcaactacctggcactggatgcctgctcatatcgcggcttgaccgaccacctcgccgagcacgatgtcaccggtggcgcaacctacgatgccctggtcggcttcacggcgaaagctgccggcgcaaagctgctgactcgcgacctgcgcgcggtcgaaacgtacgagcgattgcgggtcgaggttgagctggtgacc

SEQ ID NO: 181 - protein, 405 aa, Mycobacterium tuberculosis
VTENPYLVGLRLAGKKVVVVGGGTVAQRRLPLLIASGADVHVIAPSVTPAVEAMDQITLSVRDYRDGDLDGAWYAIAATDDARVNVAVVAEAERRRIFCVRADIAVEGTAVTPASFSYAGLSVGVLAGGEHRRSAAIRSAIREALQQGVITAQSSDVLSGGVALVGGGPGDPELITVRGRRLLAQADVVVADRLAPPELLAELPPHVEVIDAAKIPYGRAMAQDAINAVLIERARSGNFVVRLKGGDPFVFARGYEEVLACAHAGIPVTVVPGVTSAIAVPAMAGVPVTHRAMTHEFVVVSGHLAPGHPESLVNWDALAALTGTIVLLMAVERIELFVDVLLKGGRTADTPVLVVQHGTTAAQQTLRATLADTPEKVRAAGIRPPAIIVIGAVVGLSGVRGLNNS

SEQ ID NO: 182 - DNA, 1215 bp, Mycobacterium tuberculosis
gtgaccgagaacccctatctggtcgggttacggctggctggcaagaaggtcgtcgtggttggcgggggcacggtcgcccagcgccggttacccctgctgatcgccagtggcgcggacgtgcacgtgatcgcccccagcgtcacccccgccgtcgaggcgatggaccagatcaccttgtcggtgcgtgactaccgcgacggcgaccttgacggcgcctggtatgcgatcgcggccaccgatgacgcgcgggtgaacgtggctgtcgtcgccgaggcggagcgccgacggatcttttgcgtccgggccgatatcgcggtggaggggacggcggtgaccccggcgtcattcagctatgcgggcctgtcggtgggggtgctcgccggtggtgagcaccgccgttcggcggcgatccgctcggcaatccgggaggcgttgcagcagggcgtcatcactgcgcagagttccgacgtcctcagcggcggagtggcgttggtcggcggcggtcccggcgatcccgaactgatcacggttcgcggtcgccggctgcttgcccaggccgatgtcgtggtcgccgaccggctcgccccgcccgaactgctggccgagctgccgccgcacgtagaagtcatcgacgcggccaagatcccttacggccgggccatggcccaggacgcgatcaacgctgtcctgatcgaacgggccagatccggcaactttgtggtccgtctcaaagggggcgaccccttcgtgttcgcccggggctatgaagaagtgctggcatgtgcccacgccggaatcccggtcaccgtggtgccaggtgtgacgagtgccatagccgtgcccgctatggcgggcgttccagtcactcaccgggccatgacccacgaattcgtggtggtcagtggccatcttgcgcccggtcatcccgaatcgttagtgaattgggatgcattggctgcattgacgggcaccatcgttttgctgatggcggtcgaacgcatcgagcttttcgttgacgttctgctaaagggtggccgaactgcggatacgccggtactggtggttcaacacggaacgaccgccgctcaacagacgttgcgggccacccttgccgacacgccggagaaggtccgcgcggcggggatccgacctcccgcgatcatcgtgatcggggctgtagtcggcctgagcggcgttcggggtttaaacaattct

SEQ ID NO: 183 - protein, 591 aa, Mycobacterium tuberculosis
MPAPRMPRVALVAVLLITVQLVVRVVLAFGGYFYWDDLILVGRAGTGGLLSPSYLFDDHDGHVMPGAFLVAGAIIRVAPLVWTGPAISLVVLQLLESLALLRALYVISSWRPVLLIPLTFALFTPLAVPGFAWWAAALNSLPMLAALAWVCADAILLVRTGNHRYAVTGVLVYLGGLLFFEKAAVIPFVSFAVAALQCHVRGDRSALATVWRAGVRLWTPSLALTVGWVALYLAVVDQRRWSSDLSMTWDLLCRSVTHGIVPALAGGPWDWARWAPASPWATPPAVVMVLGWLVLIAVLALSLVRKRRIGPVWLTAAGYAVACQVPIFLMRSSPFTALELAQTLRYFPDLVVVLALLAAVALQAPNRAGTRWLDASPARAVATVASAVLFLTSSLYSTATFLASWRDNPTEGYLKNAQASLAAAASGAPLLDQEVDPLVLQRVAWPENLASHMFALLRVRPEFATTTTQLRMFTSTGRLVDAKVTWVRTIIAGPVPQCGYFVQPDRPERLILDGPLLPGDWTVELNYLANSDGSMALALSDGPERKVPVHPGLNRVYARLPGAGDAITVRANTTALSLCIGAAPVGFLAPA

SEQ ID NO: 184 - DNA, 1773 bp, Mycobacterium tuberculosis
atgccagcgccccgtatgcctcgggtcgccctggtcgccgtattgctgatcacggtgcagctggtggttcgcgtggtgctggcatttgggggctatttctattgggacgacttgatcctcgtcggcagggccggcactgggggcctgttgtcgccgtcgtacctgttcgacgaccacgacggccacgtgatgcccggtgccttcctggttgcgggcgccattatccgggtggcacccctggtgtggaccggaccagcgatcagcctggtggtgctgcagctgctggagtcgctggcgttgctgcgcgcgttgtatgtgatatcgagctggcggccggtactcctgatcccattgacgttcgcgctgttcacaccgctagcggtgccggggttcgcgtggtgggcggctgcgctcaactcgctgccgatgctggccgcgctggcgtgggtgtgcgccgatgccatcctgctggtgcggaccggcaaccaccgctacgccgtcaccggtgtcctggtttacctcggtggcctgctgttcttcgagaaggccgcggtgatcccgttcgtctccttcgcggtggccgcgctgcagtgccatgtgcgcggcgaccggtcagctttggcgacggtgtggcgggccggtgtccggttgtggacgccgtcgctggcactgaccgtcggctgggtagccctttatctggcggtggtggatcaacggcgatggagttccgatctgtcgatgacgtgggatctgctgtgccgttcggtcacccacggcatagtgccggcactggccggcgggccgtgggactgggcgcgctgggctccggcatccccgtgggccactcccccggcggtggtgatggtgctcggctggctggtgttgatcgcagtgcttgcgctgtcactggtccgcaagcgacgcatcggcccggtgtggctgaccgcggccggctacgcggtggcctgccaggtgccgatctttctgatgcgctcgtcgccgttcaccgcgctcgagttggcccagaccctccggtacttcccggatcttgtcgtcgtgctggcgctgctagccgccgtcgcgctgcaggcacccaatcgcgccggcacccgctggctggacgcctcgccggcccgagccgttgcgacagtcgcttcggccgtgttgtttttgaccagcagcctgtattcgaccgcgacgtttctggccagttggcgtgacaaccccaccgagggatacctgaagaacgcccaggcaagtctggccgcggccgcgtcaggtgcgccgctactggatcaggaagtcgatccgctggtgttgcaacgagtggcctggccggagaacttggccagccacatgttcgccctgctgcgcgtccgaccggaattcgctacgacaacaacacaattgagaatgttcaccagcacaggtcggctggtcgacgcgaaagtgacctgggtccggacgatcatcgcggggccggtgccgcagtgcggctacttcgtccagccggaccggccggaacgtctgatcctcgacggccccttgctgcccggcgactggaccgtcgaactcaactacctggccaacagcgacggctcgatggcgctggcactttctgacggacctgagcggaaggttccggtgcatccgggtctcaatcgggtgtacgcccggctaccaggggccggcgacgcaatcacggtgcgagccaacaccaccgcgctttcgctgtgcatcggagcggcgccggtgggatttctggcaccggcc

SEQ ID NO: 185 - protein, 498 aa, Mycobacterium tuberculosis
MTETVTRTAAPAVVGKLSTLDRFLPVWIGSAMAAGLLLGRWIPGLHTALEGVQLDGISLPIALGLLIMMYPVLAKVRYDRLDTVTGDRKLLLSSLLLNWVLGPALMFALAWLLLADLPEYRTGLIIVGLARCIAMVIIWNDLACGDREAAAVLVALNSIFQVAMFAALGWFYLSVLPGWLGLEQTTIATSPWQIAKSVLIFLGIPLLAGYLSRRIGEKTKGRNWYESRFLPKVGPWALYGLLFTIVILFALQGDQITGRPLDVARIALPLLAYFAIMWVGGYLLGAALRLGYRRTTTLAFTAASNNFELAIAVAIATYGATSGQALAGVVGPLIEVPVLVGLVYVSLALRNRLAGPNATHDADKPSVLFVCVHNAGRSQMAAGLLTHLAGDRIEVRSAGTEPAGQVNPTAVAAMAEMGIDITANAPTLLTGGQVQSSDVVITMGCGDACPYFPGVSYRNWKLPDPAGQPLDVVRMIRDDIADRVQALIAELLATAKTR

SEQ ID NO: 186 - DNA, 1494 bp, Mycobacterium tuberculosis
atgacggagacggtcacccgcaccgccgccccggcggtggtgggcaaactctcgacgctggaccgcttcttgccggtgtggatcgggtcggcaatggccgccgggctactactgggccggtggattcccggcctgcacaccgccctagaaggggttcagctcgacgggatttcgctgccgatcgcgctaggcctgctgatcatgatgtatccggtgctggccaaggtgcgctacgaccgcctcgacaccgtcaccggtgaccgcaagctgctactcagctcgctgctgctgaactgggtactgggcccggcgttgatgttcgcgctggcttggctgctactggcggatctgcccgagtaccgcaccgggctgatcatcgtgggcctggctcgctgcatcgccatggtgatcatctggaacgacctggcctgcggggatcgcgaagccgccgccgtgctcgtcgcgttgaactcgatctttcaggtggccatgttcgccgcgctcggctggttctacctgtcggtgctaccgggttggctgggcctcgagcagaccaccatcgccacatccccgtggcagatcgccaagtcggtgctgatcttcctcggcatcccgctgctggccggctacctgtcgcggcggatcggcgaaaagaccaagggccgcaactggtatgaatcccgcttcctgcccaaggtgggaccgtgggcgctctacggtttgctgttcaccatcgtgattctctttgcgctgcaaggagatcagatcaccggccgaccgctggacgtcgcacgcattgcgctgccgctgctggcctacttcgccatcatgtgggtaggcggctacctactgggggcggcgctgcggctagggtatcggcgcaccaccacgctggcgttcaccgccgcgagcaacaacttcgagctggccatcgcggtggccatcgccacctacggcgccacctccgggcaagccctggccggagtcgtcgggcccctgatcgaggtacccgtcctggtggggttggtctatgtgtccctggcgctgcgcaaccgcctcgccggtcccaacgcgacccacgatgccgacaaacccagcgtcctattcgtctgtgtgcacaacgccggacgttcccagatggccgccgggctattgacccacttggccggtgaccgcatcgaagtccgttcggccggaaccgagcccgccggtcaggtcaatccgacggctgtggccgcgatggccgaaatgggcatcgatatcaccgccaatgcccccacattgctcaccggcgggcaggtccagtccagcgacgtcgtcatcacgatgggctgcggcgatgcctgcccttacttcccgggtgtctcctaccgcaactggaaactacccgatcccgccggccagcccctcgacgttgtgcgcatgatccgcgacgacatcgcagaccgcgtccaagccctgatcgccgagctgctggccaccgccaagaccaga

SEQ ID NO: 187 - protein, 108 aa, Mycobacterium tuberculosis; identical to SEQ ID NO: 61

SEQ ID NO: 188 - DNA, 324 bp, Mycobacterium tuberculosis; identical to SEQ ID NO: 62

SEQ ID NO: 189 - protein, 475 aa, Mycobacterium tuberculosis
MADIPYGRDYPDPIWCDEDGQPMPPVGAELLDDIRAFLRRFVVYPSDHELIAHTLWIAHCWFMEAWDSTPRIAFLSPEPGSGKSRALEVTEPLVPRPVHAINCTPAYLFRRVADPVGRPTVLYDECDTLFGPKAKEHEEIRGVINAGHRKGAVAGRCVIRGKIVETEELPAYCAVALAGLDDLPDTIMSRSIVVRMRRRAPTEPVEPWRPRVNGPEAEKLHDRLANWAAAINPLESGWPAMPDGVTDRRADVWESLVAVADTAGGHWPKTARATAETDATANRGAKPSIGVLLLRDIRRVFSDRDRMRTSDILTGLNRMEEGPWGSIRRGDPLDARGLATRLGRYGIGPKFQHSGGEPPYKGYSRTQFEDAWSRYLSADDETPEERDLSVSAVSAVSPPVGDPGDATGATDATDLPEAGDLPYEPPAPNGHPNGDAPLCSGPGCPNKLLSTEAKAAGKCRPCRGRAAASARDGAR

SEQ ID NO: 190 - DNA, 1425 bp, Mycobacterium tuberculosis
atggctgacatcccctacggccgtgactatcccgacccgatctggtgtgacgaggacggccagccgatgccgccggtcggcgccgaattgctcgacgacattagggcattcttgcggcggttcgtagtctatccaagcgaccatgaactgatcgcgcacaccctctggattgcgcattgctggtttatggaggcgtgggactcaacgccccgaatcgcttttttgtcaccggaacccggctctggcaagagccgcgcactcgaagtcacggaaccgctagtgccccggccggtgcatgccatcaactgcacaccggcctacctgttccgtcgggtggccgatccggtcgggcggccgaccgtcctgtacgacgagtgtgacaccctgtttggcccgaaagctaaagaacacgaggaaattcgcggcgtgatcaacgccggccaccgcaagggagccgtcgcgggccgctgcgtcatccgcggcaagatcgttgagaccgaggaactgccagcgtactgtgcggtcgccttggccggcctcgacgacctgcccgacaccatcatgtctcggtcgatcgtggtgaggatgcgcaggagggcaccaaccgaacccgtggagccgtggcgcccccgcgtcaacggccccgaggccgagaagctgcacgaccggttggcgaactgggcggccgccattaacccgctggaaagcggttggccggcgatgccggacggggtgaccgaccggcgcgccgacgtctgggagtccctggttgcggttgctgacaccgcgggcgggcactggcccaaaaccgcccgtgcaaccgcagaaacggatgcaaccgcaaatcgaggagccaagcccagcataggcgtgctgctgctgcgggatatccgtcgagtcttcagcgaccgggaccggatgcgcaccagcgacatcctgaccggactgaaccggatggaggagggaccgtggggctccatccgccgcggcgacccgctcgacgcgcgcggcctcgcgacccggctcggcagatacggcatcgggccgaagttccagcacagtggtggcgaaccaccctacaaagggtattcgcggacccagttcgaggatgcgtggtcccggtatctctctgccgacgacgaaacccccgaggaacgagatttatcggtttccgcggtttccgcggtttcaccgccggttggcgatcccggtgatgcaaccggcgcaaccgatgcaaccgatctcccggaggcgggcgacttgccgtacgagccgccggcgcccaacgggcaccccaacggcgacgcgccgctgtgctccgggccgggatgccccaacaagctcctcagtactgaggccaaggccgccggcaaatgccggccctgccgaggtcgagcggcggctagcgctcgggacggcgcccga

SEQ ID NO: 191 - protein, 429 aa, Mycobacterium tuberculosis
VSVVAVTIFVAAYVLIASDRVNKTMVALTGAAAVVVLPVITSHDIFYSHDTGIDWDVIFLLVGMMIIVGVLRQTGVFEYTAIWAAKRARGSPLRIMILLVLVSALASALLDNVTTVLLIAPVTLLVCDRLNINTTSFLMAEVFASNIGGAATLVGDPPNIIVASRAGLTFNDFMLHLTPLVVIVLIALIAVLPRLFGSITVEADRIADVMALDEGEAIRDRGLLVKCGAVLVLVFAAFVAHPVLHIQPSLVALLGAGMLIVVSGLTRSEYLSSVEWDTLLFFAGLFIMVGALVKTGVVNDLARAATQLTGGNIVATAFLILGVSAPISGIIDNIPYVATMTPLVAELVAVMGGQPSTDTPWWALALGADFGGNLTAIGASANVVMLGIARRAGAPISFWEFTRKGAVVTAVSIALAAIYLWLRYFVLLH

SEQ ID NO: 192 - DNA, 1287 bp, Mycobacterium tuberculosis
gtgagcgtcgtcgcggtcaccatcttcgtggcggcctacgttctgattgccagcgatcgcgtcaacaagacgatggtggcgctgaccggcgcggcggccgtggtcgtcctaccagtgatcacatcccacgacatcttctattcccacgacaccggaatcgactgggacgtcattttcttgttggtgggcatgatgatcatcgtcggagtgctgcggcagacgggggtgttcgaatacaccgcgatctgggccgccaagcgcgcccgcggctcgccgctacgcatcatgatcctgctggtattggtgagcgcgttggcgtcagccttgctggataacgtcaccacggtgttgttgatcgcgccggtcacgctattggtgtgcgaccggttaaacatcaacacgacgtcgttcctgatggccgaagtcttcgcctccaacattggtggcgccgcgacgttggtgggtgacccgccgaacatcatcgtggccagccgggcgggattgacgttcaacgacttcatgctgcacttgacaccgctggtagtcattgtgctgatcgccctcatcgctgtgctgccccgcctgttcggctcgatcacggtcgaagccgatcgaattgccgatgtcatggcgctcgacgagggtgaagccatccgcgaccgcggactgctggtcaaatgtggcgccgtgctggtgctggtgttcgcggccttcgtcgcccatccggtgctgcacatccagccttctctagtggcgctgctgggcgctgggatgctgatcgtggtctcgggtctgacgcgatccgagtatctatccagcgtcgagtgggacacgctgctgtttttcgccgggctgttcattatggtcggagcgctggtcaagaccggtgtcgtcaacgatctcgcgcgggcagcgacccagctgaccggcggcaatattgtggccaccgcgttcctaatcctcggcgtctccgccccgatctcgggaattatcgacaacattccctacgtcgccacgatgacgcccctcgtcgcggagctggtcgcggtcatggggggtcaacccagcaccgacaccccctggtgggcgctggccctgggtgccgacttcggcggcaacctgaccgcaatcggcgccagcgcgaacgtcgtcatgctcggaatcgcccggcgcgcaggagctcccatctcgttctgggagttcacccgcaaaggggcggtggtcacggccgtctcgatcgcgctcgcggcgatctacctgtggttgcggtacttcgtgttgttgcac

SEQ ID NO: 193 - protein, 237 aa, Mycobacterium tuberculosis
MTRLVPALRLELTLQVRQKFLHAAVFSGLIWLAVLLPMPVSLRPVAEPYVLVGDIAIIGFFFVGGTVFFEKQERTIGAIVSTPLRFWEYLAAKLTVLLAISLFVAVVVATIVHGLGYHLLPLVAGIVLGTLLMLLVGFSSSLPFASVTDWFLAAVIPLAIMLAPPVVHYSGLWPNPVLYLIPTQGPLLLLGAAFDQVSLAPWQVGYAVVYPIVCAAGLCRAAKALFGRYVVQRSGVL

SEQ ID NO: 194 - DNA, 711 bp, Mycobacterium tuberculosis
atgacccggttggtgcctgcgctgcggctcgagctgacgctacaggtgcggcagaagttcttgcatgccgccgttttctccggactgatttggctggcagtgctgctgccgatgccggtcagcctgcgcccggtcgccgaaccctatgtcctggtgggtgatatcgcgatcatcgggttcttcttcgtcggcgggaccgtgttcttcgagaagcaggagcgcacgatcggcgcgatcgtctcgacgccgctgcggttctgggagtacctggctgccaaactaactgtgctgctggcgatctcgctgttcgttgcggttgtcgtggccaccatcgttcacgggcttggttaccacctgctgccgctggtggccggcatcgtgctgggcacactgctgatgctgctggtcggcttcagttcctcgttgccgttcgcctcggtgaccgattggttcctggcggcggtcatcccgctcgcgatcatgctggcgccgccggtggtgcactactccggcctgtggcccaacccggtgctttacctcatccccacccaggggccgctgctcttgctcggcgcggcgttcgatcaggtgagcttggcgccctggcaggtcgggtatgcggtggtctacccaatcgtgtgtgcggcgggattgtgccgggcggccaaggcgctattcggccgttatgtcgtgcaaagatcgggtgtgctg

SEQ ID NO: 195 - protein, 657 aa, Mycobacterium tuberculosis
VSKLSTAARRLLIGRPFRSDRLSHTLLPKRIALPVFASDAMSSIAYAPEEIFLVLSVAGLAAYSMAPLIGLAVAAVLLVVVSSYRQNVHAYPSGGGDYEVVTTNLGATGGLVVASALMVDYVLTVAVSISSAASNIGSVSPFVYEHKVLFAVGAIVLIMAMNLRGVRESGLAFAIPTYAFIAGIGTMLVWGLFRIFVLGNPVRAESAAFEMHAEHGQIVGFALVFLVARSFSSGCAALTGVEAISNGVPAFQKPKSRNAATTLLMLGIIAVSMFMGMIVLAVETGVQVVDDPDTQLTGAPPGYQQKTLVAQLAQAVFGGFYLGFLLIAAVTALILVLAANTAFNGFPVLGSVLAQHSYLPRQLHTRGDRLAFSNGILFLAAAAIGAVVAFRAELTALIQLYIVGVFISFTMSQVGMVRHWTRLLSAETDPRARRAMLRSRAVNTVGFVSTGTVLLIVLVTKFLAGAWIAIVAMGGFFMMMKLIHRHYDAVNRELAEQAEEAEITLPSRNHAVVLVSKLHLPTLRALTYARATRPDVLEAVTVNVDDAETRELVRQWQDSDVSVPLKVIASPYREITRPVLDYVKRVSKESPRTVVTVFIPEYVVGRWWEQLLHNQSALRLKGRLLFMPGVMVTSVPWQLTSSERIKTLQPHAAPGDT

SEQ ID NO: 196 - DNA, 1971 bp, Mycobacterium tuberculosis
gtgtccaaactttcaaccgcggcgcgtcggttgctgatcggccggccgtttcgcagtgaccggctcagtcacaccttgttgcccaagcggatcgccttgccggtgttcgcctcggatgcgatgtcgtcgatagcctacgcccccgaggagatatttctggtgctctcggtggccggcctggcggcctattcgatggcgccgttgatcggcctggcggtcgccgcggttctgctcgtggtggtgtctagttaccggcagaacgtgcacgcttacccctccggtgggggcgactacgaggttgtcaccaccaacctgggtgctaccggcggtctcgtggttgccagcgccctgatggtggattacgttctcaccgttgctgtttcgatatcgtcggcggcgtccaacatcggctctgtgagcccgttcgtgtacgagcacaaggtgttgtttgccgtcggcgcgatcgtgctgatcatggcgatgaacttgcgtggggttcgggaatccgggttggcgttcgcgatcccgacctatgcgttcatcgccggaatcggcaccatgctcgtgtgggggttgttccggattttcgtgctgggcaatccggttcgggccgagtccgcggcttttgaaatgcacgcagagcacggccagatcgtcggtttcgcgctggtgttcttggtggcgcgctcgttttcgtcggggtgtgcggcgctgacgggtgtcgaggcgatcagcaacggggtgccggcgtttcaaaagcccaagtcgcgtaacgcggcaaccacgctgctgatgctgggcatcattgcggtgagcatgtttatgggcatgatcgtgctggccgtagagaccggggtccaggtcgtcgacgatccggacacccagctgacgggcgccccgccgggttatcagcaaaagacgctggtcgcacaactggcgcaggccgtgttcgggggcttttacctggggttcttgctgatcgccgcggtgacagcgctgatcctggtgttggccgctaacaccgccttcaacggcttcccggtgctgggctcggtgctggcgcagcacagctatctgccgcgccagttgcacacccgtggggaccggctggcgttctccaacggaatcctgttcctggcggcggcggcgatcggggcggtggtcgcgtttcgtgccgagttgaccgcgctgatccagctgtacatcgtcggtgtgttcatctcgttcaccatgagtcaggtcggcatggtccggcactggacccggttgctgagcgccgagaccgatccgcgcgcccgtcgcgcgatgctgcgctcccgcgcggttaacacggtcggcttcgtgtccaccggtaccgtcctgctcatcgtgctggtaacgaaattccttgccggagcatggatcgcgatcgtcgccatgggagggttcttcatgatgatgaagctcatccacaggcactatgacgccgtcaaccgggagttggcggaacaggccgaggaagccgagataacgttgcccagccgcaatcacgccgtcgtgctggtgtcgaagctgcacctgccgacgttgcgcgcgttgacctacgcacgagcgacccggcccgacgtgttggaagccgtgacggtcaacgtcgacgatgcggaaacccgcgagctggtgcgccagtggcaggacagcgatgtgagcgtgccactcaaggtcatcgcctcgccgtaccgtgagatcacccggccggtgctcgattacgtcaagcgggtcagcaaggaatcgccacggaccgtggtgacggtattcattccggagtatgtcgtggggcgctggtgggaacagctgctgcacaaccagagtgcgctgcggctcaagggccggttgctgttcatgcccggcgtgatggtgacttcggtgccttggcaactgacgtcgtcggagcggatcaagacgttacagccgcacgcggctcccggtgacacg

SEQ ID NO: 197 - protein, 549 aa, Mycobacterium tuberculosis
VSTTSARPERPKLRALTGRVGGQALGGLLGLPRATTRYTVGHVRVPMRDGVQLVADHYAPATSQPVGTLLVRGPYGRRFPFSLVFARIYAARGYHVVLQSVRGTFGSGGVFEPMVNEAADGADTVAWLREQPWFTGRFGTIGLPYLGFTQWALLHDPPPELAAAVITVGPHDFRASVWGTGSFTVNDFLGWSDLVSHQEDPGRIRAGIRQLTAPRRVARTAATLPLGESARTLLGTGAPWFESWVEHTDRDDPFWDRLRFPAALDRVQVPVLLVGGWQDIFLRQTLQQYRHLRDRGVHVALTVGPWTHTQMLTKGLATGARESLDWLDAHLGRAPALRPSPVRVFVTGQGWRHLPDWPPATTERAWYLQPGGRLGESAPASGTPPATFRYHPADPTPTTGGPLLSSNGGYRDDSRLATRADVLCFTGAPLTHDLCVHGNPVVELVHSSDNPYVDVFVRVSEVDAKGRSRNVSDGYRRLGDAPELVRVELDAIAHRFRADSRIRVLIAGSWFPRYARNLGTPEPILTGRQLKPATHAVHFGRSRLLLPVG

SEQ ID NO: 198 - DNA, 1647 bp, Mycobacterium tuberculosis
gtgagtaccacctccgctcggcccgagcggcccaagctgcgcgccctgaccggacgagtcggtgggcaggccctgggcggactgttgggtctgccccgcgcaaccacccgctacaccgtcggtcacgtccgagtcccgatgcgcgacggcgtccagctggtggccgaccactacgcacccgccacgtcgcagcccgtcggcaccctgctggtgcgtgggccatacgggcgccggtttccgttttcgctggtgtttgccaggatttacgccgcccgcggttatcacgtcgtgctgcagagcgtgcgcgggacgttcgggtccggtggcgtgttcgagcccatggtcaacgaggccgccgacggcgccgatacggtggcgtggctgcgtgaacagccctggttcaccggccggttcggcaccatcggcctgccctatctgggtttcacccagtgggcgttgctgcacgatccgcccccggagctggccgcggccgtgatcacggtggggccgcacgacttccgggcctcggtgtggggcaccggatcgtttacggtcaacgacttcctgggctggagcgatctggtttcccaccaggaagaccccggtcgcatccgggccggaatccgccagctcaccgcgccgcgacgggtggcgcggacggccgccacgttgccgctgggtgagtcggcccggacgctgctcggcacgggtgcgccgtggttcgaatcctgggtggaacacaccgaccgcgacgatccgttctgggaccgactgcggtttcccgccgcgttggaccgcgtccaggtcccggtgctgctcgtcggcggctggcaggacatcttcctgcggcagacgctgcagcagtaccggcacctgcgcgaccggggtgtgcacgtcgcgctgacggtcggtccctggacacacacccagatgctcaccaaggggctggccaccggcgctcgggaatcgttggactggttggacgcccacctcggccgggcgccggcgctgcgccccagcccggtgcgggtcttcgtcaccggccagggctggcggcacctgccggactggcctccggcgaccaccgagcgggcgtggtacctgcagcccggtggccgcctgggtgagagcgctccggcttccggcacgccaccggcgacgtttcgctaccaccccgccgacccgacaccgaccaccggtggtccgctactgtcatccaacggcggttaccgcgacgacagccggctggccacgcgcgccgatgtgctgtgcttcaccggggcgcccctcacccacgacctctgcgtgcacggaaaccccgtcgtcgagctggtgcacagctcggacaacccctacgtcgacgtgttcgttcgggtcagcgaggtggacgcgaagggccggtcccgcaatgtcagcgacggctaccggcgccttggtgacgcgccggagctggtccgcgtcgagctggacgccatcgcccaccgattccgcgccgactcccgcatccgggtgctgatcgccggtagttggtttccccgctatgcgcgaaacctcggcaccccggaaccgatactcaccggacggcagctcaagccggctacccacgcggtgcatttcgggcgctcccggctgctgctgcccgtcggc

SEQ ID NO: 199 - protein, 469 aa, Mycobacterium tuberculosis
VAVGDDEEKVRAERARAIGLFRYQLIWEAADAAHSTKQRGKMVRELASREHTDPFGRRVRISRQTIDRWIRGWRAGGFDALVPNPRQCTPRTPAEVLELAVALRRENPQRTAAAIRRILRTQLGWAPDERTLQRNFHRLGLTGATTGSAPAVFGRFEAEHPNALWTGDVLHGIRIDLRKTYLFAFLDDHSRLVPGYRWGHAEDTVRLAAALRPALASRGVPNAVYVDNGSPYVDAWLLRACAKLGVRLVHSTPGRPQGRGKIERFFRTVREQFLVEITGEPDVVGRHYVADLAELNRLFTAWVETVYHRSVHSETGQTPLARWSAGGPIPLPAPETLTEAFLWEEHRRVTKTATVSLHGNRYEIDPALVGRKVELVFDPFDLTRIEVRLAGAPMRRAIPYHIGRHSHPKAKPETPTAPPKPSGIDYAQLIETAHAAELARGVNYTALTGAADQIPGQLDLLTGQEAQPK

SEQ ID NO: 200 - DNA, 1407 bp, Mycobacterium tuberculosis
gtggcggtcggcgatgacgaggagaaggtgcgcgcggagcgcgcgagggcgatcgggttgtttcgctaccagttgatttgggaggccgccgatgcggcgcattccaccaagcagcggggaaagatggtgcgcgagttggcctcacgcgagcacaccgatccgttcgggcggcgggtgcgcatcagccgccaaaccatcgaccgctggatccggggctggcgggccggcgggttcgacgcgctggtgcccaacccacgccagtgcacaccgcgtaccccggccgaggtgctggagctggcggtggcgctgcggcgggaaaacccgcagcgcacggcggcggcaatccggcggatcctgcgtacccagttgggctgggcgcccgatgaacgcaccctgcaacgcaacttccaccggctcgggctcaccggcgccaccaccgggtcggcgccggcggtgttcggccggttcgaagccgagcacccgaacgccctgtggaccggggatgtgttgcacggcatacggattgatctccgcaagacctatctgttcgcgttcttagacgaccattcccggttggtgcccggctaccggtggggccatgccgaggacacggtgcggctggccgccgcactgcgcccggcgctggcctcccgcggcgtgcccaacgcggtgtatgtcgataacggctcgccctatgtggatgcgtggttgttgcgggcatgcgcgaaactcggtgtgcgccttgttcattccacgccaggtcggccgcaaggcaggggcaagatagagaggttcttccgcaccgtgcgcgagcagttcctggtcgagatcaccggcgaacccgacgtcgtcggccgacattacgtcgctgatctggccgagttgaatcggctgtttacggcctgggtcgaaacggtttatcaccgcagcgtgcattccgaaaccgggcagaccccgctggcccgctggtcagccggcggccccatcccgctgcccgcccccgagacgctcaccgaggccttcctgtgggaggagcaccgccgcgtgaccaagaccgccaccgtctcgctgcacggcaaccgctacgagatcgacccggcgctggtcggccggaaagtggagttggtgttcgacccgttcgatttgacccgcatcgaggtgcggctggccggcgcgccgatgaggcgggccattccgtatcacatcgggcgccattcacacccgaaagccaaacccgaaacccccaccgcaccgcccaaacccagcggcatcgactacgcgcagttaatcgagaccgcgcacgcagccgaactcgcccgcggcgtcaactacaccgccctcaccggggctgccgatcagatccccggccagctcgacctgctcaccggccaggaggcccaaccgaaa

SEQ ID NO: 201 - protein, 270 aa, Mycobacterium tuberculosis
MMHKLISYYGFSRMPFGRDLAPGMLHRHSAHNEAVARIGWCIADRRIGVITGEVGAGKTVAVRAALASLDRSRHTIIYLPDPTVGVQGIHHRIVASLGGQPLTHHATLAPQAADALAAEQAERGRTPVVVVEEAHLLGYDQLEALRLLTNHDLDSSSPFACLLIGQPTLRRRMKLGVLAALDQRIGLRYAMPPMTDTNTGSYLRHHLKLAGRDDALFSDDAIGLIHQTSRGYPRAVNNLALQALVAAFAADKAIVDESTTRTAIAEVTAD

SEQ ID NO: 202 - DNA, 810 bp, Mycobacterium tuberculosis
atgatgcacaaactgatctcgtattacggtttttcgcgcatgccattcggccgcgatctggcaccgggcatgctgcatcgccacagcgcgcacaacgaagcggtcgcccgcatcggctggtgcatcgccgaccgccgcatcggcgtcatcaccggcgaagtcggcgccggcaagaccgtcgccgtgcgcgccgcactagcgagcctggatcgcagccgccacaccatcatctacctgcccgaccccaccgtcggcgtccagggcatccaccaccgcatcgtcgcctcgctcggcggacaacccctcacccaccacgccaccctggccccacaggccgccgacgcgctagccgccgaacaagccgagcgcggacgcacccccgtcgtggtcgtcgaggaagcgcacctgctcggctatgaccaactggaggcgttgcggctcttgacaaatcacgacctcgactcgtcaagcccgttcgcctgcctgctcatcggccaacccaccctgcggcggcggatgaaactcggcgtgctcgccgcgcttgaccagcgcatcggactccgatatgccatgccgcccatgaccgacaccaacaccggcagctacctacgccaccacctcaagctagccggacgcgacgatgccctgttctccgacgacgccatcgggttgatccaccagaccagccggggctacccccgcgcggtcaacaacctcgccctgcaagccctcgtcgccgccttcgccgccgacaaggccatcgtcgacgaatccaccacccgcaccgccatcgccgaagtcacggcagac

SEQ ID NO: 203 - protein, 303 aa, Mycobacterium tuberculosis
MAAPQRARLRSSKERVRDYALFVVLVGPNVALLLLFVYRPLADNIRLSFFDWNVSDPSARFVGLSNYTEWFTRSDTRQIVFNTAVFTGAAVVGSMVLGLALAMLLDRPLRGRNLVRSTVFAPFVISGAAVGLAAQFVFDPHFGLIQDLLRRIGVGVPDFYQDARWALFMVTITYVWKNLGYTFVIYLAALQGVRRDLLEAAEIDGASRWAVFRRVLLPQLRPTTFFLSITVLINSLQVFDVINVMTRGGPEGTGTTTMVYQVYVETFRNFRAGYGATVATIMFLVLLAVTYYQVRVMDRGQRQ

SEQ ID NO: 204 - DNA, 909 bp, Mycobacterium tuberculosis
atggcggcgccgcaacgagcacggcttcggtcatcgaaagagcgcgtgcgcgattatgcgctgttcgtcgtgttggtcggccccaatgtggcgctattgctgctgttcgtctatcgcccgttggccgacaacatccggctgtcgttcttcgactggaacgtctccgatccgtcggcccgatttgtggggttatccaactacaccgagtggttcacccggtcggacacccgccagatcgtgttcaacacggcggttttcaccggtgccgcggtggtcggctcgatggtgctggggttggcgctggcgatgctgctcgatcgaccgttgcgtggacgaaacctggtgcgctccactgttttcgcgccgttcgtgatctccggtgccgctgtcggcctggccgcccagttcgtcttcgacccgcatttcggtctgattcaagacctgttgcgccggatcggggtcggggtgcccgacttttaccaggatgcgcgctgggcgttgttcatggtgaccatcacctacgtctggaagaacctcggctataccttcgtgatctatctggccgcgttgcagggggtacgccgagatctgttggaggcggccgaaatcgacggcgccagccggtgggccgtgttccgtcgagtgctgttgccgcagctgcggccgaccacgtttttcttgtcgatcaccgtgctgatcaactcgctgcaggtgttcgatgtgatcaacgtgatgacccggggcgggccggagggcaccggcaccaccaccatggtgtaccaggtgtatgtggagacgttccgcaatttccgggccggttatggcgccacggtggccacgatcatgttcctggtgctgctggccgtgacgtactaccaggtgcgggtgatggatcgggggcagcggcag

SEQ ID NO: 205 - protein, 695 aa, Mycobacterium tuberculosis
MVESRRAAAAASAYASRCGIAPATSQRSLATPPTISVPSGEGRCRCHVARGAGRDPRRRLRRRRWCGRCGYHSHLTGGEFDVNRLCQQRSRERSCQLVAVPADPRPKRQRITDVLTLALVGFLGGLITGISPCILPVLPVIFFSGAQSVDAAQVAKPEGAVAVRRKRALSATLRPYRVIGGLVLSFGMVTLLGSALLSVLHLPQDAIRWAALVALVAIGAGLIFPRFEQLLEKPFSRIPQKQIVTRSNGFGLGLALGVLYVPCAGPILAAIVVAGATATIGLGTVVLTATFALGAALPLLFFALAGQRIAERVGAFRRRQREIRIATGSVTILLAVALVFDLPAALQRAIPDYTASLQQQISTGTEIREQLNLGGIVNAQNAQLSNCSDGAAQLESCGTAPDLKGITGWLNTPGNKPIDLKSLRGKVVLIDFWAYSCINCQRAIPHVVGWYQAYKDSGLAVIGVHTPEYAFEKVPGNVAKGAANLGISYPIALDNNYATWTNYRNRYWPAEYLIDATGTVRHIKFGEGDYNVTETLVRQLLNDAKPGVKLPQPSSTTTPDLTPRAALTPETYFGVGKVVNYGGGGAYDEGSAVFDYPPSLAANSFALRGRWALDYQGATSDGNDAAIKLNYHAKDVYIVVGGTGTLTVVRDGKPATLPISGPPTTHQVVAGYRLASETLEVRPSKGLQVFSFTYG

SEQ ID NO: 206 - DNA, 2085 bp, Mycobacterium tuberculosis
atggttgagtcgagacgagctgctgcggcggcttcggcatacgcaagcagatgcgggattgcacccgcgacctcgcaacgctcactggcgacaccaccgacgatctcggtcccgtccggtgagggccgctgccgttgccacgtcgcaaggggtgccggtcgtgacccacgacggcgacttcgacgccgtcgatggtgtggccgatgtggctatcattcgcatctgacgggtggcgagttcgacgtgaaccgactctgtcaacagcgctcgcgtgagcggtcctgccaactcgttgccgtcccggcagatccaagacctaaacggcaacgaataaccgatgtgttgaccctcgcactagtcggcttcctcggcggcctcatcaccggaatatcaccatgcattctgccggtcctgccagtaatcttcttctccggcgcgcagagcgtcgatgcagcgcaggtggcgaaacccgaaggcgccgtagcagtccggcgcaaacgtgcgctatcagcgacattgcggccctaccgggtgatcggtggtctggtgctcagtttcggcatggtcaccctgctcggctcggcattgctgtcagtgctgcatctaccgcaggacgccatccgctgggccgcactggtcgccttggtggcaatcggcgccggcctcattttcccgcggtttgaacaacttctggaaaaaccgttctcccgtattccgcagaagcaaatcgtcactcgcagcaacggtttcgggctgggtctagccctgggcgtgttgtatgtcccctgcgccggcccgattctagctgcgatcgtcgtggccggggctactgccaccatcgggttgggaaccgtcgtgctcaccgcgacattcgcactcggagccgcgttgccgttgttgttcttcgccctcgccggccaacggatagctgagcgggtgggcgcttttcggcgccgccagcgtgagatcaggatcgccaccggttccgtgacgatcctgctggcggtggcgttggtgttcgatctgccggccgcgctgcagcgggctattcctgactacaccgcatcgctgcagcagcagatcagcaccggcacggagatacgggaacaactgaaccttggcggcatcgtcaacgcccagaacgcacagctgtcgaattgcagcgacggggccgcacaactcgaaagctgcggcactgcaccagatctcaaaggcatcaccggctggctcaacacgcccggcaacaagccgatcgacctgaaatcattgcgtggcaaggtggtgctgattgacttttgggcctactcctgcattaactgccaacgggccatcccccacgtcgtcggttggtatcaggcctacaaagacagtggtttggcggtcatcggcgtgcacacccccgagtacgctttcgagaaggtcccgggcaacgtcgccaaaggcgcggccaatctgggcatcagctatccgattgcgctcgacaacaactacgccacttggaccaactaccggaatcgctattggcccgccgagtatctgatcgacgctaccgggacggtgcggcacatcaagttcggagaaggcgattacaacgtcaccgagacgttggtcaggcagttgctcaacgatgccaagcccggcgtcaaactcccccagcccagcagcaccaccacgcccgaccttaccccgcgggccgcacttactcccgagacgtacttcggagtcggcaaggtggtcaactacggcggcggcggcgcatatgacgaagggtcggccgtgtttgactacccgcccagtttggcagccaacagctttgcactgcgcggccggtgggcgctggactatcagggtgccacgtccgacggcaacgacgccgctatcaaattgaattaccacgccaaagacgtctacatcgttgtcggtggcaccggcaccctcacggtcgtgagggacggaaagccagccacactaccgatcagcgggccgccgaccacccatcaggtggtcgccggctatcggctggcgtccgaaacacttgaggtgcggcccagcaaggggctacaggttttttccttcacctacgga

SEQ ID NO: 207 - protein, 287 aa, Mycobacterium tuberculosis
VNEALIGLAFAAGLVAALNPCGFAMLPAYLLLVVYGQDSAGRTGPLSAVGRAAAATVGMALGFLTVFGIFGALTISAATAVQRYLPYATVLIGLALIALGGWLLLGRGLTALTPRSLGVRWAPTVRLGSMYGYGISYAVASLSCTIGPFLAVTGAGLRGGSVVGSVAIYLAYVAGLTLVVGVLAVAAATASSALADRLRRILPFVNRISGALLVVVGLYVGYYGLYELRLIAGVGANPQDAVIAAAGRLQGALAGWVNQHGAWPWAVLLVVLVVGAFAGTWFRRVRR

SEQ ID NO: 208 - DNA, 861 bp, Mycobacterium tuberculosis
gtgaacgaggcgctgatcggtttggcgttcgccgccgggttggtggctgcgctgaacccatgcgggtttgccatgttgccggcctacctgctgttggtggtgtatgggcaggattcggcgggccggacggggccgcttagcgcagtgggccgagcggcagccgccacggtcgggatggcgctgggcttcttgacggtgttcggcatcttcggagccctgaccatttccgcggccacggcggtgcagcgatacctgccctatgccacggtgctgatcggtctggcgctcatcgccctcggcgggtggctgctgttgggacgagggctgacggcgttgacgccccgatccctcggcgtgcgttgggctccaacggtacggctgggttccatgtatggctacggcatcagctatgcggttgcttcgctgtcatgcaccatcgggccgtttctcgcggttaccggggcaggcctgcggggcggttcggtcgtcgggagcgtagcgatctatctggcttatgtcgcgggcctgaccctcgttgtcggcgtgcttgccgtcgcggccgcgaccgcgagctcggcgctggccgaccgcctacggcgaatcttgccgttcgtcaaccggatcagtggcgcgctgctggtggtggtcgggctgtacgtgggttactacggtctctacgagctgcgcctgattgccggtgtcggggcgaatccccaggatgcggtgattgccgcggccggccgcctgcaaggtgccctggctggctgggttaaccagcacggtgcatggccttgggcggtgttgctggttgtgctggtggtcggtgccttcgccggtacctggtttcggcgggtgcggcgc

SEQ ID NO: 209 - protein, 413 aa, Mycobacterium tuberculosis
MLTVEDWAEIRRLHRAEGLPIKMIARVLGISKNTVKSALESNQQPKYERAPQGSIVDAVEPRIRELLQAYPTMPATVIAERIGWERSIRVLSARVAELRPVYLPPDPASRTTYVAGEIAQCDFWFPPIELPVGFGQTRTAKQLPVLTMVCAYSRWLLAMLLPSRCAEDLFAGWWRLIEALGAVPRVLVWDGEGAIGRWRGGRSELTTECQAFRGTLAAKVLICRPADPEAKGLIERAHDYLERSFLPGRVFASPADFNAQLGAWLALVNTRTRRALGCAPTDRIGADRAAMLSLPPVAPATGWCTSLRLPRDHYVRCDSNDYSVHPGVIGHRVLVRADLERVHVFCDGELVADHERIWAVHQTVSDPAHVEAAKVLRRRHFSAASPVVEPQVQVRSLSDYDDALGVDIDGGVA

SEQ ID NO: 210 - DNA, 1239 bp, Mycobacterium tuberculosis
atgttgactgtggaagattgggctgagattcgccgattgcatcgcgcggagggtttgccgatcaagatgatcgcccgggtgctggggatttccaagaacacggtgaagtcagcgttggaatcaaaccagcagccgaaatatgaacgggcaccgcagggttcgatcgttgatgcggttgagccgcggatccgggagttgttgcaggcctatccgacgatgccggcgacggtgatcgccgagcggatcggctgggagcgctcgattcgggtgctctcggcgcgggtggccgagctgcgcccggtgtatctgccgccggacccggcgtcgcgcaccacgtatgtggcaggcgaaattgcccagtgcgacttctggtttccgccgatcgagttgccggtagggttcgggcagacccgcacggccaaacagttgccggtgctgaccatggtgtgcgcctattcgcgctggctgttggcgatgctgctgcccagcaggtgtgccgaggacctgttcgccggctggtggcggctgatcgaggcgttgggggcggtgccgcgggtgttggtgtgggatggcgagggcgcgatcgggcgctggcgcggcgggcggtcggagttgaccactgagtgtcaggcgttccgcggcacgctggcggccaaggtgctcatctgccggccggccgacccggaggccaagggcctcattgaacgggcccacgactacctggagcgctcgtttttgcccgggcgggtgtttgcctcgccggccgatttcaacgcccaactgggcgcctggctggcgctggtgaacacccgcacccgccgggcgctgggttgtgcgcccaccgatcgcatcggcgcggatcgggccgcgatgctgagcttgccgccggtggcgccggccaccgggtggtgcacctcgctgcggctgccccgggatcactatgtgcgctgcgattccaacgactactcggtgcacccgggtgtgatcgggcatcgggtgctggtgcgcgccgacctggagcgggtgcatgtgttctgcgacggtgagctggtcgccgaccacgagcggatctgggcggtccatcagacggtctccgatcccgcacatgtggaggcggcgaaggtgttgcgccgccggcacttcagtgcagcatcaccggtagttgagccgcaggtgcaggtccgctcactgagcgactacgatgacgcgctgggagtcgacatcgatggcggggtggcc

SEQ ID NO: 211 - protein, 153 aa, Mycobacterium tuberculosis
VDVIWSATIATTVATGMRKPRMHGMPPITSGSMVTRVTRMSIRLAGDSTLGRFSTSRLGLSSAKSKPEGDFGTACGAVSGGDAGVVALAEGVDDGQSKPGAAGGARGVGGFRESRADCGEQFGVASWTPQGEFEFGGQEAKGVRSSWPASLTN

SEQ ID NO: 212 - DNA, 459 bp, Mycobacterium tuberculosis
gtggatgtcatttggtccgcgaccatcgcgaccacagtcgccactgggatgcgcaagccccggatgcatggcatgcctcccatcacgtcggggtcgatggtgacgcgggtgactcgcatgtctataaggctagccggtgacagcacgctggggcggttctccaccagccgtcttggcttaagctcagccaagagcaagccggagggagatttcggcaccgcctgcggcgcggtttcgggcggtgacgctggcgtggttgcgttggctgagggtgtcgacgatggccagtccaagcccggtgccgccggtggtgcgcgcggtgtcggtggtttccgcgagagccgagcggattgcggcgagcagttcggggttgcttcgtggacgccgcagggcgagttcgagttcggtggtcaggaggctaagggggtgcgaagttcgtggcccgcatcgctgacgaat

SEQ ID NO: 213 - protein, 337 aa, Mycobacterium tuberculosis
VSVFATATGIGSWPGTAAREAAQVVVGELAGALAYLTELPARGVGADMLGRAGGLLVDVAIDTVPRGYRIAARPGAVTRRAASLLDEDMDALEEAWETAGLRGCGRAVKVQAPGPVTLVAGLELANGHRAITDPGAVRDLAASLAEGVAAHRAALARRLDTPVVVQFDEPSLPAALGGRLTGVTALSPVAPLDETVAEALLDTCIAAVDADVALHSCSPDLPWDLLQRSRISAVSVDASTLQAADLDAVAAFVESGRTVVLGLVPVTAPERAPSMEEVAAAAVAVTDRLGVPRSALRDRLGVSPACGLANATGQWARTAVGLARDVAEAFARDPEAI

SEQ ID NO: 214 - protein, 1011 aa, Mycobacterium tuberculosis
GTGAGTGTTTTCGCAACGGCCACCGGGATCGGATCGTGGCCGGGCACCGCCGCGCGAGAGGCCGCGCAGGTCGTGGTCGGGGAGTTGGCGGGTGCATTGGCCTATCTCACCGAGCTGCCCGCCAGGGGCGTCGGCGCCGACATGCTGGGGCGAGCCGGCGGACTGCTGGTCGACGTGGCGATTGACACCGTGCCTCGTGGCTACCGCATCGCTGCTCGACCCGGCGCGGTGACACGGCGGGCCGCGAGCCTCCTCGACGAGGATATGGATGCCTTAGAAGAGGCCTGGGAGACCGCGGGCCTGCGTGGCTGTGGGCGGGCGGTGAAGGTGCAGGCGCCCGGGCCAGTCACATTGGTCGCGGGGTTGGAGCTGGCCAACGGTCACCGGGCGATCACCGACCCCGGAGCCGTGCGTGACCTGGCCGCCTCGCTGGCCGAAGGCGTTGCCGCGCATCGCGCGGCGCTGGCGCGTCGACTTGACACACCGGTGGTGGTGCAGTTCGACGAGCCGTCGTTGCCGGCGGCGTTGGGCGGCCGGCTGACCGGGGTGACCGCGTTGAGCCCGGTTGCCCCGCTCGACGAGACGGTGGCCGAAGCGCTGCTCGACACTTGCATCGCGGCTGTCGACGCGGACGTAGCGCTACACAGCTGCAGTCCGGATTTGCCGTGGGATCTGCTGCAGCGCAGCAGAATTAGTGCGGTATCGGTGGATGCGAGCACACTGCAGGCTGCGGATTTGGATGCTGTCGCGGCATTTGTCGAGTCGGGCCGAACCGTCGTGCTGGGCCTGGTCCCGGTGACCGCCCCGGAGCGAGCACCTTCGATGGAAGAGGTCGCTGCTGCGGCGGTCGCGGTCACCGATCGGCTCGGCGTTCCTCGCTCGGCGCTACGCGATCGACTCGGCGTCAGCCCGGCGTGTGGTCTGGCCAATGCGACGGGGCAGTGGGCCCGCACCGCGGTCGGGCTTGCCCGTGATGTCGCTGAGGCGTTCGCGCGGGACCCAGAGGCCATC

SEQ ID NO: 215 - protein, 81 aa, Mycobacterium tuberculosis
VTAPVWLASPPEVHSALLSAGPGPGSLQAAAAGWSALSAEYAAVAQELSVVVAAVGAGVWQGPSAELFVAAYVPYVAWLVQ

SEQ ID NO: 216 - DNA, 243 bp, Mycobacterium tuberculosis
gtgacggcgccggtgtggttggcgtcgccgccggaggtgcattcggcgctgctaagtgctggtccggggccgggttcgttgcaggcggccgcggcggggtggagcgcgttaagcgccgagtacgccgctgtggcgcaagagttgagcgtggtggtggccgcggtgggggccggggtgtggcagggtcccagtgctgagttgtttgtggccgcctatgtgccgtatgtggcgtggttggtgcag

SEQ ID NO: 217 - protein, 254 aa, Mycobacterium tuberculosis
VPEFVNVVVSDGSQDAGLAMLLLSRPPTNAMTRQVYREVVAAANELGRRDDVAAVILYGGHEIFSAGDDMPELRTLSAQEADTAARIRQQAVDAVAAIPKPTVAAITGYALGAGLTLALAADWRVSGDNVKFGATEILAGLIPSGDGMARLTRAAGPSRAKELVFSGRFFDAEEALALGLIDDMVAPDDVYDAAAAWARRFLDGPPHALAAAKAGISDVYELAPAERIAAERRRYVEVFAAGQGGGSKGDRGGR

SEQ ID NO: 218 - DNA, 762 bp, Mycobacterium tuberculosis
gtgcccgagttcgtcaacgtcgtggtcagtgacggctcccaggatgccggcctggccatgttgctcctatcgcgaccgcctaccaacgcgatgacccgccaggtctaccgggaagtggtcgccgcggccaacgagctggggcgacgcgacgacgtggccgcagtgatcctgtatggcggccacgaaatcttctccgccggcgacgacatgcccgaactgcggacattgagcgcgcaggaggccgacaccgccgcccggattcggcagcaggccgtcgacgccgttgcggcgatccccaagccgaccgtggccgccatcaccggatacgcgttgggtgccggccttacgctggccctagccgccgattggcgagtcagcggtgacaacgtgaaattcggcgcgaccgagatcctggccggcctgatccccagcggcgacggaatggcccggctgacccgtgcggccggtccgagcagagccaaggagctggtgttcagcgggcgcttcttcgacgccgaggaggccttggcgctgggcctgatcgacgacatggtggcccccgacgacgtttacgacgccgcggcggcctgggcgaggcgctttcttgacggcccgccgcacgcgctggccgcggccaaagccgggatcagcgacgtctacgagctggcgccggccgagcggatcgccgctgagcgtcggcgctatgtcgaggtgttcgccgctggtcaaggtggtggcagcaagggtgaccggggcggccgt

SEQ ID NO: 219 - protein, 721 aa, Mycobacterium tuberculosis
MGIALTDDHRELSGVARAFLTSQKVRWAARASLDAAGDARPPFWQNLAELGWLGLHIDERHGGSGYGLSELVVVIEELGRAVAPGLFVPTVIASAVVAKEGTDDQRARLLPALIDGTLTAGVGLDSQVQVTDGVADGEAGIVLGAGLAELLLVAAGDDVLVLERGRKGVSVDVPENFDPTRRSGRVRLDNVRVTTDDILLGAYESALARARTLLAAEAVGGAADCVDSAVAYAKVRQQFGRTIATFQAVKHHCANMLVAAESAIAAVWDAARAAAEDEEQFRLAAAVAAALAFPAYARNAELNIQVHGGIGFTWEHDAHLHLRRALVTVGLFGGDAPVRDVFERTAAGVTRAISLDLPAQAEELRARIRSDAAEIAALEKDAQRDKLIETGYVMPHWPRPWGRAAGAVEQLVIEEEFSAAGIERPDYSITGWVILTLIQHGTPWQIERFVEKALRQQEIWCQLFSEPDAGSDAASVKTRATRVEGGWKINGQKVWTSGAQYCARGLATVRTDPDAPKHAGITTVIIDMLAPGVEVRPLRQITGDSEFNEVFFNDVFVPDEDVVGAPNSGWTVARATLGNERVSIGGSGSYYEAMAAKLVQLVQRRSDAFAGAPIRVGAFLAEDHALRLLNLRRAARSVEGAGPGPEGNITKLKVAEHMIEGAAIAAALWGPEIALLDGPGRVIGRTVMGARGMAIAGGTSEVTRNQIAERILGMPRDPLIS

SEQ ID NO: 220 - DNA, 2163 bp, Mycobacterium tuberculosis
atgggtattgcattgaccgacgaccatcgcgagctctccggggtggctcgcgcgttcttgacttcgcagaaggtgcgctgggcggcgcgtgcatcactggacgcggcgggggacgcccgcccgccgttctggcagaacctcgccgagctgggctggctcggcctgcatatcgacgagcgacacggtggctctggctatggcctgtccgagcttgtggtggtgatcgaagagctcggtcgtgcggtggcaccggggctgtttgtgccgaccgtgatcgcctcagcggtggtcgccaaagaaggtactgatgaccaacgggcacggctgttgccggcgctgattgacggaaccctgacggcgggtgtgggactggatagtcaggtgcaggttaccgacggtgttgccgacggtgaggcgggaatcgtgttgggcgccgggcttgccgagctgctgttggttgccgccggtgacgacgtgctggtgttggaacgcggccgcaagggcgtctcggttgatgtgccggaaaactttgatccgacccggcggagtggccgcgtgcgcctggacaacgtgcgcgtcacgaccgacgacatcctgcttggtgcgtatgaatcggctttggcccgcgcgcgcacattgctggccgccgaggccgtcggtggggcggccgactgcgtggacagcgccgtggcctatgccaaggtgcgacagcaattcggccgtaccatcgccacgtttcaagcggtgaagcatcactgcgcgaacatgctggtggccgccgagtcggcgatcgccgcggtctgggatgccgcgcgtgcggcagcagaggatgaggagcagtttcggctggccgccgcggtcgctgcggccctggcgtttccggcctatgcacgcaatgccgagctcaacatccaggtgcacggcggtattggctttacctgggagcatgacgcgcatctgcatctgcgccgggcgttggtgaccgtgggattgttcggcggtgatgcgcccgtccgagacgttttcgagcgcaccgcggctggcgttacccgggcgatcagcttggacctgccggcacaggccgaggagctgcgcgcccgcatccgttcggacgccgctgaaatcgctgctctggaaaaggatgcacagcgcgacaagctgatcgagacgggctatgtgatgccgcattggcccaggccgtggggtcgtgccgcgggcgcggtggagcagttggtgatcgaggaagagttcagcgcggcgggcatcgagcgcccggattactcgatcaccgggtgggtgatcttgacgctgattcagcacggaacgccttggcagattgaaagattcgtcgagaaagcgctgcgccagcaggagatatggtgccaactgttctccgaacctgacgcggggtctgacgcggcctcggtcaagacccgcgcaactcgggtggagggcggctggaagatcaacgggcaaaaggtgtggaccagcggagcgcagtactgcgcgcgtggcctggctaccgtgcgtaccgatccggatgcccccaaacacgctggcatcaccacggtgatcatcgacatgttggcccccggtgtcgaggtgcggccgctgcggcagatcaccggcgactcggaattcaacgaggtgttcttcaacgatgtcttcgtccccgatgaggacgttgtcggggcgccgaactccgggtggacggtggcgcgggcaacgctgggcaacgagcgggtcagcatcggcggcagtggctcgtactacgaagcaatggcggcgaagctggtgcaattggtccagcggcggtcagatgcgtttgcgggcgccccaattcgagtcggcgctttcctcgcagaggatcacgcactgcggctgctgaacctgcgccgtgccgctcgcagcgtcgaaggagccggccctggtccggagggcaacatcaccaagctcaaagtggcagagcacatgatcgagggcgccgccatcgcggccgcgctatgggggcccgagattgcgttgctggacggccccggcagggtgattggccgaacggtgatgggcgcccgtggcatggcgatcgccggcggcacgtcggaggtgacccgcaatcagattgccgagcggatcctgggcatgccgcgtgatcccctgattagc

SEQ ID NO: 221 - protein, 141 aa, Mycobacterium tuberculosis
MVKDLDRRLAGCLPAVLSLFRLVYGLLFAGYGSMILFGWPVTSAQPVEFGSWPGWYAGVIELVAGLLIATGLFTRAVAFVASGEMAVAYFWMHQPYALWPIGGPPDGNGGTPAILFCFGFFLLVFTGGGIYSIDARRTVTA

SEQ ID NO: 222 - DNA, 423 bp, Mycobacterium tuberculosis
atggtgaaagatctcgaccgtcggctcgccggctgtttgccggctgtgctgagcctctttcggttggtatacgggctgctgttcgccggctacggatcgatgatccttttcggctggcccgtcacctcggctcaacccgtcgaatttggatcctggcccggctggtatgccggggtcatcgagttggtggcaggtctgctgatcgcaaccgggctgtttacccgcgctgtggcgttcgttgcctcgggcgaaatggcggtcgcctacttctggatgcatcaaccgtatgcactgtggccgatcggcggtccaccggacggcaatggcggaactccggcgatactgttctgcttcggcttcttcctgctggtgttcaccggtggtgggatctactcaattgatgctcgacgcactgtcactgca

SEQ ID NO: 223 - protein, 437 aa, Mycobacterium tuberculosis
VVSYVVALPEVMSAAATDVASIGSVVATASQGVAGATTTVLAAAEDEVSAAIAALFSGHGQDYQALSAQLAVFHERFVQALTGAAKGYAAAELANASLLQSEFASGIGNGFATIHQEIQRAPTALAAGFTQVPPFAAAQAGIFTGTPSGAAGFDIASLWPVKPLLSLSALETHFAIPNNPLLALIASDIPPLSWFLGNSPPPLLNSLLGQTVQYTTYDGMSVVQITPAHPTGEYVVAIHGGAFILPPSIFHWLNYSVTAYQTGATVQVPIYPLVQEGGTAGTVVPAMAGLISTQIAQHGVSNVSVVGDSAGGNLALAAAQYMVSQGNPVPSSMVLLSPWLDVGTWQISQAWAGNLAVNDPLVSPLYGSLNGLPPTYVYSGSLDPLAQQAVVLEHTAVVQGAPFSFVLAPWQIHDWILLTPWGLLSWPQINQQLGIAA

SEQ ID NO: 224 - DNA, 1311 bp, Mycobacterium tuberculosis
gtggtgtcttatgttgttgcgttgccggaggtgatgtccgccgcggccacagacgtggcttcgattggttcggtggtcgcgacggcgagccagggtgtcgcgggtgccaccacgacggtattagccgctgccgaggacgaggtgtcagccgcgatcgcggctttgttttccggccatggtcaggactatcaagctcttagcgcacagcttgcggtgtttcatgagcggtttgtgcaggcattgacaggcgcggccaaggggtatgccgccgccgagctggccaacgcttcgctgttgcagagtgaattcgccagcggtatcgggaacggttttgccacgattcaccaggaaattcagcgggcccccacggcgctggccgccggattcacgcaggttccgcctttcgcggcggcgcaggcagggatcttcaccggcacgccgtcaggggctgccggattcgacatcgcttcgctgtggccggtgaaacccctgctgagtttgtctgcgctcgaaactcactttgcaatcccaaacaatccacttttagcgctcattgccagcgacataccgccgctgtcgtggtttcttggcaactccccaccgccgttgctgaactcgctgctgggacagacggtccagtacaccacctatgacgggatgagcgtcgtgcagatcacgccggctcatccaaccggcgaatacgtggttgccattcacggcggcgcgtttatcctgccgccgtcaatcttccactggctcaactactcggtgacggcttaccagaccggcgcgaccgtgcaagtgccgatttacccgttggtgcaggaaggaggcactgccgggacggtagtaccggcgatggccgggctcatctccacgcaaatcgcgcaacacggggtctccaacgtcagcgtggtcggggactccgcgggcggcaacctcgcactggcggccgcccaatacatggtgagccagggcaacccagtaccgtcgtccatggtgttgctgtccccgtggctcgatgtggggacctggcagatcagccaggcgtgggcaggcaatcttgcggtcaacgacccgctggtcagtccgctgtatgggtcgctgaacggtcttccgccgacgtatgtctattcgggctcgcttgatccgctcgcacaacaagcggttgtcctcgagcacacagccgtagtccaaggagcgccgttcagcttcgtactggccccctggcaaatccacgactggatactgctcaccccctggggtttgctgtcctggccgcagattaaccagcaactcggtatcgccgcc

SEQ ID NO: 225 - protein, 527 aa, Mycobacterium tuberculosis
MRSWWGWGTVEDALSDQETQALQSRVAALVSGHDLSDHPPPDLTALGLAAPRVSPPASLAALCSSDLVDRAGHARGKAYRDIARNLQGQLDHLPDLIARPRSEQDVIDVLDWCAREGIAVIPYGGGSSVVGGVEPRFDEPVVTVDVTAMSAVLEIDRVSRAARIQAGAFGPSIEHQLRPHDLTLRHFPQSFGFSTLGGWLATRSGGHFATLYTHIDDLTESLRIVTPVGISESRRLPGSGAGPSPDRLFLGSEGTLGIITEAWMRLQHRPRWQVTVSVVFDDWAAAVAATRTIAQAGLYPANCRLLDPAEALLNAGTSVGGGLLVLAFESADHPIDPWLHRAVAITAEHGGTVTAQRSRGTTSDATEHNAAANWRSAFLRMPYQRDALVRRGVIAETFETACTWDGFDTLHAAVTDAARTAIWKVCGTGVVTCRFTHVYPDGPAPYYGIYAGGRWGSLDAQWDEIKAAVSEAISASGGTITHHHAVGRDHRAWYDRQRPDPFAAALRAAKSALDPAGILNPGVLLGR

SEQ ID NO: 226 - DNA, 1581 bp, Mycobacterium tuberculosis
atgcgttcgtggtggggttggggcacagtcgaggacgcgctctccgatcaggagacgcaagcgctacagtcgcgagtcgcggcactggtgtccggccatgacctgagcgaccacccgccgccggacctgaccgcgctcggtttggcggccccacgggtcagcccgccggcatcgctggccgcgctctgctcaagcgatctcgtcgatcgggccggacacgcgcgcggcaaagcgtatcgcgacatcgcacgcaacctgcagggccagctcgaccacctgcccgacctcatcgcccgaccccgcagcgagcaggacgtgatcgacgtgctggattggtgtgcgcgcgaggggattgcggtcatcccatacggtggtggcagctcggtggttggcggtgtcgagccgcgcttcgatgagccggtggtcacggtcgacgtcactgccatgagcgcggtgcttgagattgaccgtgtcagccgtgccgcgcgcatccaggcgggtgcgttcggcccctcgatcgagcatcagcttcgcccacacgatttgacactgcgccatttcccgcagtccttcggcttctcgactctcggtggctggttggccacccgctccggcggacacttcgccacgctctatacccatatcgacgacttgaccgaatcgctgcggattgtcaccccggtggggatcagcgagtcccggcggctgcccggaagcggtgccggaccatccccggaccggttgttcctcgggtccgaggggacgcttggcatcatcaccgaggcgtggatgcggctgcaacaccgtccgcgatggcaggtcacggtgtccgtggtgtttgacgactgggccgccgcggtcgccgcgacccggacgatcgctcaggcggggctgtacccggccaactgccggctgttggatccggccgaggcgttgctgaatgccggcacgtccgttggtggcgggctgttggtgttggcgttcgagtctgccgaccacccgatagacccgtggctgcaccgggcggtggcgatcaccgccgaacacggcggcacggtgaccgcgcaacgtagccgcggaactacaagcgacgcaacggaacacaacgcagccgcgaactggcgctcggcgtttctgcgcatgccgtatcaacgagacgcgctggttcgccgcggagttatcgccgaaacattcgaaaccgcttgcacctgggacggattcgatactctacatgccgcggtgaccgatgccgctcggaccgcgatctggaaggtatgcgggaccggagtagtgacctgtcgattcacccatgtctacccggacggcccggctccttactacggcatctatgccggcgggcgctgggggtcgctcgacgcgcagtgggacgagatcaaggctgccgtgtccgaggcgatcagcgccagtggcggtaccatcacccaccaccatgcggtcggtcgcgaccaccgcgcttggtatgaccggcagcgtcccgacccgttcgcggcggccctgcgggcggcgaagtccgcactcgacccggccgggatcctcaacccaggggtgttgctcggtcgc

SEQ ID NO: 227 - protein, 145 aa, Mycobacterium tuberculosis
MTSFAHPGTRGLSTVFGLMMVGSAAVGSHGLAVVVGLAAVIAVGVAAVFRLAATLAVVLSVVMIVVSGPTHVLAALSGFCAAVYLVCRYGAGVVAGSWPTTVAAVGFTFAGLAATSFPLQVPWLPLAAPLAVLATYVLATRPFSR

SEQ ID NO: 228 - DNA, 435 bp, Mycobacterium tuberculosis
atgacctcgtttgcgcacccgggtactcgtgggctctccacggtgttcggactgatgatggtggggtcggccgctgtgggatcgcacgggctggctgttgtcgtggggcttgccgcggtgattgcggtaggggtggcggcggtgtttcgcctggcggcaacgcttgccgtggtgttgtcggtggtgatgatcgtggtgtccggcccgacgcatgtgcttgccgcattgtcggggttttgcgccgccgtctacctggtgtgccgatacggggccggtgttgtcgccgggagctggccgacgaccgttgccgccgttggtttcacgttcgctgggttggctgcgacgtcgttcccgctgcaagtgccatggctgccgttggcggcaccgttggccgtgttggctacctacgtgctggccacccgtccgttctcgagg

SEQ ID NO: 229 - protein, 119 aa, Mycobacterium tuberculosis
LRLGAGFRKPVPTLLLEHRSRKSGKNFVAPLLYITDRNNVIVVASALGQAENPQWYRNLPPNPDTHIQIGSDRRPVRAVVASSDERARLWPRPVDAYADFDSCQSWTERGIPVIILRPR

SEQ ID NO: 230 - DNA, 357 bp, Mycobacterium tuberculosis
ttgcgactcggcgccggattccgcaaaccggtgccgacactgctactcgaacaccggagccgcaagtccggcaagaacttcgtcgcaccactgctttacatcaccgaccgtaacaatgtcatcgtcgttgcctctgcccttgggcaggcagaaaacccgcagtggtatcgcaacctgccgcccaatcccgacacccacattcagatcggatccgatcgccgcccggtgagagccgtcgtggccagctcggacgagcgggcgcgcctatggccgcgcccagtagacgcctacgccgacttcgattcttgccaaagctggaccgagcgtgggattccggtgatcatcttgcggccacgc

SEQ ID NO: 231 - protein, 108 aa, Mycobacterium tuberculosis; identical to SEQ ID NO: 61

SEQ ID NO: 232 - DNA, 324 bp, Mycobacterium tuberculosis; identical to SEQ ID NO: 62

SEQ ID NO: 233 - protein, 133 aa, Mycobacterium tuberculosis
MPDVDWNMLRGNATQAAAGAYVPYSRFAVGAAALVDDGRVVTGCNVENVSYGLTLCAECAVVCALHSTGGGRLLALACVDGHGSVLMPCGRCRQVLLEHGGSELLIDHPVRPRRLGDLLPDAFGLDDLPRERR

SEQ ID NO: 234 - DNA, 399 bp, Mycobacterium tuberculosis
atgcctgatgtcgattggaatatgctgcggggcaatgcaacccaggcagcagccggagcctatgtgccgtattcgcggtttgcggtgggtgcggccgcactggtcgacgatggtcgcgtggtgaccggatgcaacgtggaaaacgtctcgtatggcttgactttgtgcgccgaatgtgcggtggtgtgcgccctgcattcgaccggcggcggccggctgctcgcgctggcctgcgtcgacggccatggatccgtgctgatgccgtgcgggcgatgccgtcaggtgctgctcgaacacgggggttccgagctactgatcgaccatccggtgcgaccccgccggctcggcgacctgctgcccgacgccttcggcctcgacgacctcccccgggaacgccgg

SEQ ID NO: 235 - protein, 204 aa, Mycobacterium tuberculosis
MSVQTDPALREHPNRVDWNARYERAGSAHAPFAPVPWLADVLRAGVPDGPVLELASGRSGTALALAAHGRQVTAIDVSDVALLQLDSEAVRRGVADRLNLVQADLGCWEPGETRFALVLSRLFWDAAIFHRACEAVMPGGVLAWESLALSGAEAGTASAKRRVKPGEPACLLPADFTVVHEGQGNCDSAPSRIMIARRSPLPGA

SEQ ID NO: 236 - DNA, 612 bp, Mycobacterium tuberculosis
atgagcgtgcagacggatccggcgctgcgggagcaccccaaccgcgtcgactggaacgcgcgatacgaacgcgcgggttcggcgcacgcgccgtttgccccggtgccttggctcgccgatgtcctcagagcaggcgttccggacggtcccgttctggagttagccagcggtcgatcgggtaccgcactggcgttggccgcccacggccgccaggtcaccgcaatcgatgtgtccgatgtcgcgctgctgcagctggacagcgaggccgtgcgtcgaggcgtggccgatcggctcaacctcgtgcaggccgacttgggctgctgggaacccggcgagacgcgtttcgcgctggtgctcagcaggctcttttgggatgcggcgatatttcaccgcgcctgtgaggcggtgatgccaggcggcgtattggcatgggagtcgctggctctcagtggcgccgaggcgggcacagccagcgcgaagcgacgtgtcaagccgggagagccagcgtgtctgcttcctgccgacttcaccgttgtacacgaggggcagggtaactgcgattcggcgccgtcgcggatcatgatcgcgcggcgctcaccgttgccaggggca

SEQ ID NO: 237 - protein, 264 aa, Mycobacterium tuberculosis
VLASCPARSGAAVADAIKSAVGVQPSGVEHKTLRRMDLVRYLAGGHTTYPPEGFVAGSDVIGTTNPAAAQAIVAAIGTWPPAAGRASALIDSLGGAVGDMDPEGSAFPWCRQSAVVQWYVNTPSDGQVATANKWLSDAHHAVQHFSVGGYVNYLEANAAASQYFGANLSRLTTVRRKYDPDRIMYSGLDFSTRQVAERLLPALGFRVRFGVLVIRCALCTDTVKRLGTLPNLTWSRLKVNVAVTQEQAGVMDLPALPVRRTPRR

SEQ ID NO: 238 - DNA, 792 bp, Mycobacterium tuberculosis
gtgctggcgagctgcccggcgcggtccggcgcggctgtcgcggatgcgatcaagtccgcggttggagtgcaacccagtggagttgagcacaagacgctgcgccgtatggacctggtgaggtatctggccggcggccatacgacctatccgccggagggcttcgtggctggatccgatgtcatcgggacgacgaatccggccgcggcccaagccatcgtcgccgccatcggaacatggccacccgctgcgggccgcgcgtcggctctgatcgattcgctgggcggcgcggtgggcgacatggacccggagggctcggcatttccctggtgccgccagtccgctgtggtgcagtggtatgtcaacacccccagcgacggccaggtggcgacggccaacaaatggctgagcgacgcacaccacgcggtgcaacacttttcggtcggcggctatgtcaactacctggaggccaacgccgcggcgtcacaatacttcggcgcgaacctgtcgcggctgaccacagtgcggcgcaagtacgatcccgaccggatcatgtactcgggtctggatttctctaccagacaggtcgctgaacgacttttacccgctctcggctttcgagtgaggttcggggttttggtaatcaggtgcgcactgtgcactgacactgtgaaacgcttgggaactttgcccaaccttacgtggtcgcgcttaaaagtgaacgtcgcagtgacccaagaacaggctggggtcatggatttgccggcgctgccggttcggcgcacgccgcggcgg

SEQ ID NO: 239 - protein, 123 aa, Mycobacterium tuberculosis
VSAATDLYAVHQALAGESRAIPTGSCPTVGVAGLTLGGGLGADSRHAGLTCDALKSATVVLPGGDAVSASADDHAELFWALRGGGGGNFGVTTSMTFARFPTADCDVVRVDFAPSAAAQVLVG

SEQ ID NO: 240 - DNA, 369 bp, Mycobacterium tuberculosis
gtgtcggccgcgaccgatctctatgcggtccatcaagcgttggccggtgagagccgggcgattccgaccggcagctgcccgaccgtgggtgtggcgggtttgaccctgggcggcgggttaggcgccgattctcgccatgcggggttgacctgcgatgcgctcaagtcggcgacggtggtgttgcccggcggtgatgcggtgagcgcgtctgccgacgaccacgcggagctgttctgggcgcttcgtggcggcgggggcggcaacttcggggtgacgacatcgatgacgttcgcgaggttccccaccgcggactgcgatgtcgtccgtgtcgatttcgcgccgtctgcggccgcgcaggtgctggtcggc

SEQ ID NO: 241 - protein, 213 aa, Mycobacterium tuberculosis
MRRRAMTKMDEASNPCGGDIEAEMCQLMREQPPAEGVVDRVALQRHRNVALITLSHPQAQNALNLASWRRLKRLLDDLAGESGLRAVVLRGAGDKAFAAGADIKEFPNTRMSAADAAEYNESLAVCLRALTTMPIPVIAAVRGLAVGGGCELATACDVCIATDDARFGIPLGKLGVTTGFTEADTVARLIGPAALKYLLFSGELIGIEEAARW

SEQ ID NO: 242 - DNA, 639 bp, Mycobacterium tuberculosis
atgaggcggcgtgcaatgacgaagatggacgaggctagcaatccgtgcggcggggacatcgaagctgagatgtgccagttgatgcgcgagcaaccacccgccgaaggcgtcgtcgatcgtgtcgcgctgcaacgccatcgaaacgttgcgttgatcacgctgagccatccgcaggcgcagaacgcactcaacctggcgagctggcgtcggctgaagcggctgctggacgatctcgccggcgaatcggggctgcgggcggtggtgctgcggggcgccggtgacaaggcgttcgccgcgggtgccgacatcaaggagtttccgaacacccgcatgagcgccgcggacgccgcggagtacaacgagagcctggccgtctgcctgagggcgttgaccacgatgccgatcccagtcatcgcggcggtccgggggctcgccgtcggtggcggctgtgagctggcgacggcctgcgatgtgtgcatcgcgaccgacgacgcgcgcttcggcatcccgctgggcaagctcggcgtcacgacgggcttcaccgaggcggacaccgtcgcgcgcctcatcggtccggcggcgctgaagtatctgttgttcagcggagaactgatcggcattgaggaagccgcccgctgg

SEQ ID NO: 243 - protein, 467 aa, Mycobacterium tuberculosis
VADRLNVAERLAEGRPAAEHTQSYVRACHLVGYQHPDLTAYPAQIHDWYGSEDGLDLHALDADCAQLRAAASVLMEALRMERSQVAVLAAAWTGSGADAAVHFVQRHCETGNSVVTEVRAAAQRCESLRDNLWQLVDSKVATAIAIDERALAQRPAWLAAAEALTTEGADRPTAVEVVRQQIQPYVDDDVRNDWLTTMRSTTAGVAASYDAVTDQLASAPRAHFEIPDDLGPGRQPSPASVPAQPSATAAITPAAALPPPDPVPAVTSRPVTPSDFGSAPGDGSATPAGVGSAGGFGDAGGTGGLGGFAGLAGLANRIVDAVDSLLGSVAEQLGDPLAADNPPGAVDPFAEDAADNADDGDDAHPEEADEAAEPKEATEPDEADEVDDADESVPAERAQDVAEEATLPPVAEPPPPAAPPVAEPPPPVAAPAPPGAPEPANGPSPEALSEGATPCEIAADELPQAGP

SEQ ID NO: 244 - DNA, 1401 bp, Mycobacterium tuberculosis
gtggctgaccggttgaacgtcgctgagcgtctcgccgagggcaggcccgcagccgagcacacgcaaagctacgtgcgggcttgccacctggtgggctaccaacatcccgacctgaccgcctaccctgcccagatccacgactggtacggcagcgaagacggacttgacctgcacgcgctcgacgctgactgcgcgcagctgcgggctgccgccagtgtgctcatggaggcgctgcggatggagcgtagccaggtcgccgtcttggcagcggcatggacgggatcgggggccgacgcggcggtgcactttgtgcagcgtcactgtgagactggaaattcggtggtcaccgaagtccgtgccgcggcccaacgctgcgaatcgctgcgcgacaacctctggcagctggtggactccaaagtcgcgacggccattgcgatcgacgagcgtgccctggcgcagcggccggcatggttggctgcggccgaagcgctcacgacggagggggcagatcggccgacggccgtcgaagtggttcgccaacagatacagccctacgtggacgacgatgttcgcaacgactggctgaccacgatgcgatcgacaacggccggtgtggcggcgtcgtatgatgcggtcaccgatcagctggccagcgcgccgcgcgcgcacttcgagattccggacgatctcgggcccggtcgccaaccttctccggcatcggtgccggctcaaccgagcgcgacggcagcgattacgcccgcggccgctcttcccccgccggatccggtgccggccgtgacctcgcggccagtgacgccgtcggattttggatcggcgccaggtgatggttccgcgacgccggcgggtgttggcagcgccggtggtttcggcgatgccggcggcaccggcggtctgggcgggtttgccgggcttgccgggcttgccaaccggatcgtcgatgcggtggatagcctgctgggttcggtggccgaacagctgggggatccgttggcagctgacaatccgccgggtgccgtcgatccgttcgctgaagacgcggccgacaacgctgatgacggcgacgatgcccacccggaagaggccgacgaggcagcggagccgaaggaagcaacagagcccgacgaagcagacgaggtcgacgacgccgacgaatcggtgcccgctgaacgtgcccaggatgtcgccgaggaggccacgctgccgccggtcgccgaaccgccgccgcctgccgcgcctccggtcgccgaaccaccgcctccggtcgctgcgccggcgccgccgggtgcgccggaaccggcgaatgggccttcgccggaagcgctgtccgagggagccaccccctgtgagatcgccgccgacgagcttccgcaggcggggccg

SEQ ID NO: 245 - protein, 404 aa, Mycobacterium tuberculosis
VSPHRAVIEAGPGAIRRLCCGADVVADTAVSAAALAAIDDQVALLDERPVAVDSLWFDALRSVAVDHRDGPVVVHPSWWSAARVEVVTAAARTLTRDVVVHPRSWLLRQASSGVSAATVVVEIAERLVLVAGAEVAAVARRTDAESVAGQVGSVIARMTRGITAVVLIDVPSTVAGAAALAAAIAGAVRGTGSSVVEIDGVRLARLARAALPPSDEPADPAARPATRSRVPTLARVAAAGVALALLAPAAVVRHGATTLQRPPTTLLVEGRVALTIPADWSTQRVVSGPGSARVQVTSPADPEVALHVTQSPVPGETLPGTAQRLKRAIDASPAGVFVDFNPSDIRAGRPAVTYREVRAGHQVRWTILLDGAVRISVGCQSGPGHEDLLREVCAQAVRSVHAVG

SEQ ID NO: 246 - DNA, 1212 bp, Mycobacterium tuberculosis
gtgagcccacatcgcgcggtgatcgaggcgggtccgggtgccatccgccgattgtgttgtggcgcagacgtagtcgcggacaccgcagtgtctgccgccgcgctggcggcgatcgacgaccaggtagcgctgctggacgaacggccagtcgccgtggattcgctgtggttcgacgccctgcgatcggtggccgtcgaccaccgtgacggcccggtcgtcgtgcacccgtcgtggtggtcggcggctcgggtcgaggtggtcaccgcagccgcacgcacgctgacccgcgatgtcgtcgtgcacccgcggtcgtggctgctgaggcaggcgtcctcgggggtttcggccgcaacggtggtggtggagatcgcggagcgactggtgttggtggccggcgccgaggtcgccgcggtggcccgccgcacggacgccgagtccgttgccggccaggtaggcagtgtcattgcgcggatgacgcggggtattaccgcggtggtgctgatcgacgtgcccagtacggtcgccggggcggcagcgctcgcggcggcaatcgccggtgcggtgcggggtaccggtagcagcgtggtcgagatcgacggcgtgcggctggcgcggttggccagggccgccctgccgccttccgacgagcccgccgatccggcggcgcggcctgccacccgctctcgggtcccgacacttgcccgggttgcggccgccggtgtcgccttggcgttactggcgccggctgccgtggtccgccacggtgcgacaaccctgcaaagaccaccgacgacgcttctggtagagggccgggtggcgctgacgattccggcggactggtccacgcagcgggtggtctccggtcccggttcggcgcgggtacaggtcacttcaccggccgatcccgaggtggcgttgcacgtcacacaatcaccggttcccggtgagacgctgcctggcaccgcgcagcggttgaagcgggcgatcgacgcgtcaccggccggggtattcgtcgacttcaacccctccgatatcagagccggccggcccgcggtgacctatcgagaggtccgcgccgggcatcaggtgcggtggacgattctgctcgacggagcggtccggatcagcgtcggctgccagagcgggcccggccatgaagacctcctcagggaggtgtgtgcgcaagccgtacggtccgtccacgccgttggt

SEQ ID NO: 247 - protein, 1236 aa, Mycobacterium tuberculosis
MNSGPACATADILVAPPPELRRSEPSSLLIRLLPVVMSVATVGVMVTVFLPGSPATRHPTFLAFPMMMLVSLVVTAVTGRGRRHVSGIHNDRVDYLGYLSVLRTSVTQTAAAQHVSLNWTHPDPATLWTLIGGPRMWERRPGAADFCRIRVGVGSAPLATRLVVGQLPPAQRADPVTRAALRCFLAAHATIADAPIAIPLRVGGPIAIDGDPTKVRGLLRAMICQLAVWHSPEELLIAGVVSDRNRAHWDWLKWLPHNQHPNACDALGPAPMVYSTLAEMQNALAATVLAHVVAIVDTAERGNGAITGVITIEVGARRDGAPPVVRCAGEVTALACPDQLEPQDALVCARRLAAHRVGHSGRTFIRGSGWAELVGIGDVAAFDPSTLWRNVNQHDRLRVPIGVTPDGTAVQLDIKEAAEQGMGPHGLCVGATGSGKSELLRTIALGMMARNSPEVLNLLLVDFKGGATFLDLAGAPHVAAVITNLAEEAPLVARMQDALAGEMSRRQQLLRMAGHLVSVTAYQRARQTGAQLPCLPILFIVVDEFSELLSQHPEFVDVFLAIGRVGRSLGMHLLLASQRLDEGRLRGLETHLSYRMCLKTWSASESRNVLGTQDAYQLPNTPGAGLLQTGTGELIRFQTAFVSGPLRRASPSAVHPVAPPSVRPFTTHAAAPVTAGPVGGTAEVPTPTVLHAVLDRLVGHGPAAHQVWLPPLDEPPMLGALLRDAEPAQAELAVPIGIVDRPFEQSRVPLTIDLSGAAGNVAVVGAPQTGKSTALRTLIMALAATHDAGRVQFYCLDFGGGALAQVDELPHVGAVAGRAQPQLASRMLAELESAVRFREAFFRDHGIDSVARYRQLRAKSAAESFADIFLVIDGWASLRQEFAALEESIVALAAQGLSFGVHVALSAARWAEIRPSLRDQIGSRIELRLADPADSELDRRQAQRVPVDRPGRGLSRDGMHMVIALPDLDGVALRRRSGDPVAPPIPLLPARVDYDSVVARAGDELGAHILLGLEERRGQPVAVDFGRHPHLLVLGDNECGKTAALRTLCREIVRTHTAARAQLLIVDFRHTLLDVIESEHMSGYVSSPAALGAKLSSLVDLLQARMPAPDVSQAQLRARSWWSGPDIYVVVDDYDLVAVSSGNPLMVLLEYLPHARDLGLHLVVARRSGGAARALFEPVLASLRDLGCRALLMSGRPDEGALFGSSRPMPLPPGRGILVTGAGDEQLVQVAWSPPP

SEQ ID NO: 248 - DNA, 3708 bp, Mycobacterium tuberculosis
atgaattcagggccggcgtgcgcgactgcggacatcctggttgccccgccgcccgagttgcggcggtcggaaccgtccagcctgctgattcgcctgctcccggtcgtcatgtcggtggcgaccgtgggtgtcatggtgacggtgttcttgccgggctcgccggccacgcgccaccccacgtttctggccttcccaatgatgatgctggtctcgttggtggtgactgcggtaaccggacgcggccggcggcatgtctccggtatccacaacgaccgtgtcgactacctcgggtacctgagtgtcttgcgcacatctgtcacccaaacggctgcagcacaacacgtatcactgaactggacgcatcccgatcctgccaccttgtggacattgatcggtggtccgcgaatgtgggagcgtcgaccgggtgctgccgacttctgtcgcatccgtgtcggagttggatctgcaccgctggccacccgcttggtggtcgggcagcttccgccggcgcagcgtgcggatccggtcacccgcgccgcgctgcgctgtttccttgccgcacacgcgaccattgcggatgcgcccatcgcgatccccttgcgggtcggcggtccgatcgccatcgacggtgacccgaccaaggtccgcgggctgctgcgggcgatgatctgccagctggccgtatggcactcaccggaggagttgctgatcgccggcgtggtcagtgaccgcaaccgcgcgcactgggattggctgaaatggctgccgcacaaccaacatccgaatgcctgtgatgccttggggccagccccgatggtgtactcgaccctggcagagatgcaaaatgcgctagccgcaacggtattggcccacgttgttgcgatcgtcgacacggccgaacgtggcaacggcgcgatcaccggcgtgatcacgatcgaggtgggcgccagacgagacggtgcaccgccggtggtcagatgtgccggcgaagtgacagcgctagcgtgcccggaccagctggagcctcaagacgcgctggtatgcgcccgtcggctggccgctcaccgggtcgggcactcgggtcgcacgttcatccgtggctcgggttgggcggaactggtcggcatcggcgatgtggccgctttcgatccgagcacgttgtggcgcaacgtaaaccaacatgatcggctccgtgtcccgatcggagtcacgcccgacggtaccgccgtgcagctagacatcaaggaagccgcggaacagggcatgggtccacacgggctgtgcgtcggcgccaccggatcaggcaaatcggagctgctgcgtaccatcgcgctggggatgatggcacgcaattcgcccgaagtcctcaacctccttctggtcgacttcaagggtggtgcaacatttctcgacctcgcgggagccccacatgtagccgcggtcatcaccaaccttgccgaggaagcaccgctggtcgcacggatgcaagacgcattggccggcgagatgagccgccggcaacagctgctgcggatggcaggccacttggtcagtgtcacggcatatcagcgggcacgccaaacgggtgcgcaacttccctgcctgccgatcctgttcatcgtcgtcgacgagttttccgaattgctgagccaacatcccgaattcgtcgacgtgttcctcgcgatcggtcgggtgggccggtcgctgggcatgcatttgctgctggccagtcagcggctcgacgagggccgactgcgtggactggaaacccatctgtcctatcgaatgtgcctgaaaacgtggtccgccagtgaatcacgcaacgtgctcgggacgcaggacgcatatcaactgcccaacacccccggtgcgggcttgctgcaaacgggaaccggagagctgatccgatttcagaccgcgttcgtttccgggccgcttcgacgggcgagtccctcagcggtccacccggtagccccgccgtcggtgcgaccgttcaccacgcacgctgcggcgccggtcacagccggtcccgtcggcgggacagccgaggtgcccacgcctaccgtcttgcatgcggtgctcgaccggctggtcggtcatggaccggctgcgcatcaagtctggctaccgccgctggacgagccaccgatgctgggcgccctactgcgtgacgctgagccggcgcaggccgagctggccgtacccatcggcattgtcgatcggccgttcgagcagtcacgggtgccgctgacgatcgacttgtccggggccgcaggcaatgtcgcggtcgtaggtgcaccgcaaacgggcaagtcaaccgcgctgcggacgctgatcatggcgttggctgctacccacgatgcgggccgggtgcagttctattgtttggacttcggcggcggggcgctggcccaggtggacgaactgccgcatgtgggtgccgtggccggcagggcgcagccgcagctggcatcgcggatgctcgccgaactggagtcggccgtgcgatttcgggaggcattcttccgcgaccacggcatcgactcggtggcgcggtaccgccagctgcgagcaaagtcggccgctgagtcttttgcggacatatttcttgtcatcgacggctgggcaagcttacgccaggagttcgcggcccttgaggagtcgatcgttgccctggcagctcaagggctttcattcggcgtacatgtggcgctatcggcagcacggtgggcggagatcaggccgtcgctgcgggatcagatcggcagtcgaatcgagttacggctggcggatcccgcggattccgaattggaccgtaggcaggcgcaacgggtgccggtcgacagaccgggccgtggcctctcccgcgacgggatgcacatggtgatcgccctgcccgacctggatggagttgcgctacgacgccgaagtggtgatccggtggcgcccccgataccgctactgcccgcgcgcgtggactacgacagcgtcgtggcccgagccggcgacgaactcggtgcgcacatcttgctcggcctcgaggaacgtcgaggccagccggtggccgtcgatttcggacgccacccgcacctgctggtgctgggcgacaacgagtgcggaaagacggccgcgttgcggaccctgtgccgcgagatcgtccggacccataccgccgcgcgagcccaacttctcatcgtcgacttccggcacaccctgctcgacgtcatcgagtcggaacatatgagcggctacgtcagctcgccggcggcgctgggtgccaagctgtcgagtctggtcgacctgctccaggcgcggatgcccgccccggatgtgagccaggcgcagctgcgagccaggtcctggtggtcgggtccggatatctatgtcgtggtcgacgactacgacctggttgcggtctcatcgggcaacccgctgatggtcttgctcgaatatttgccgcacgcaagagatctcggtttacacctggtggtggcgcggcgcagcgggggtgctgctcgggcgctgttcgagccggtgcttgccagcctgcgtgacctgggctgccgggcactgctgatgagcggacgtccggatgaaggcgcactgttcgggtcgagccgcccgatgccgctgccaccgggccggggcatcctggtcaccggtgccggtgacgagcaactggttcaagtcgcctggagcccacccccg

SEQ ID NO: 249 - protein, 470 aa, Mycobacterium tuberculosis
VPSPATTWLHVSGYRFLLRRIECALLFGDVCAATGALRARTTSLALGCVLAIVAAMGCAFVALLRPQSALGQAPIVMGRESGALYVRVDDVWHPVLNLASARLIAATNANPQPVSESELGHTKRGPLLGIPGAPQLLDQPLAGAESAWAICDSDNGGSTTVVVGPAEDSSAQVLTAEQMILVATESGSPTYLLYGGRRAVVDLADPAVVWALRLQGRVPHVVAQSLLNAVPEAPRITAPRIRGGGRASVGLPGFLVGGVVRITRASGDEYYVVLEDGVQRIGQVAADLLRFGDSQGSVNVPTVAPDVIRVAPIVNTLPVSAFPDRPPTPVDGSPGRAVTTLCVTWTPAQPGAARVAFLAGSGPPVPLGGVPVTLAQADGRGPALDAVYLPPGRSAYVAARSLSGGGTGTRYLVTDTGVRFAIHDDDVAHDLGLPTAAIPAPWPVLATLPSGPELSRANASVARDTVAPGP

SEQ ID NO: 250 - DNA, 1410 bp, Mycobacterium tuberculosis
gtgccgagcccagcgacgacctggctgcacgtcagcgggtaccgatttctgctgcggcgcatcgagtgcgcgttgctgttcggggatgtctgcgcagcgaccggagcactgcgcgcgcgcacaacatcgctggccctcgggtgcgtgctggcgatcgtcgccgcgatgggatgcgcattcgttgcgctgctgcggccacagtcggcgctcggtcaggcgccgatcgtgatgggtcgggaatccggggcactctacgtgcgagtggacgatgtctggcatccggtgttgaacctggcttcggcgcggttgatcgcggcgacgaacgccaacccgcaaccggtgtccgagtccgaattgggccacaccaaacgcggtccactgctcggtattccaggtgcgccgcagctgcttgaccagccgctagccggcgccgaatcggcgtgggcgatctgcgatagcgacaatggcggatcaacgactgtcgtcgtcgggcccgccgaagactcgtcggcgcaggtgctgaccgccgaacagatgatcctggtggcgaccgaatcaggttcgcccacctacctgctctacggcggtcggcgggccgtggtggatctggccgacccggcggtggtgtgggcgctgcggctgcagggccgggtcccgcacgtggtcgcgcaatcgttgctcaacgccgtcccggaggcaccgcgcatcacggctccccggattcgtggcggcgggcgggcctcggtcgggctgcccgggtttctggtcggcggtgtggtgcgcatcactcgcgcgagcggtgatgagtattacgtggtgctggaggacggcgtgcagcgcatcggccaggtcgccgcggatttgttgcggttcggcgattcgcagggcagcgtcaacgtcccgacggtggcccccgatgtgattcgcgtcgctccgatcgtgaacaccttgccggtgtcggcctttcccgaccggccgccaacaccggtggacggctcgccgggaagggcggtcaccacgttgtgcgtgacctggacgcccgcgcagccgggtgctgctcgcgtcgcgttcttggcgggcagcggcccgccggtgcccctcggaggggttccggtgacactggcacaagccgacggtcgcggccccgcactggacgcggtgtacctgccgccgggacgcagcgcctacgtagccgcgcgcagcctgtccggcggcggcaccggcacgcgctacctggtcaccgacaccggagtgcggttcgcgatccacgacgacgacgtggcacacgacctcggtctgccgacggctgccatcccggcgccgtggccggtgttggcgacactgccgtccggaccggagctgagtagagccaacgcgtcagtcgcccgcgataccgttgcgcccgggccg

SEQ ID NO: 251 - protein, 317 aa, Mycobacterium tuberculosis
VSTRQAAEADLAGKAAQYRPDELARYAQRVMDWLHPDGDLTDTERARKRGITLSNQQYDGMSRLSGYLTPQARATFEAVLAKLAAPGATNPDDHTPVIDTTPDAAAIDRDTRSQAQRNHDGLLAGLRALIASGKLGQHNGLPVSIVVTTTLTDLQTGAGKGFTGGGTLLPMADVIRMTSHAHHYSPASGRYPQAIFDHGTPLALYHTKRLASPAQRIMLFANDRGCTKPGCDAPAYHSQAHHVTAWTSTGRTDITELTLACGPDNRLAEKGWTTHNNTHGHTEWLPPPHLDHGQPRTNTFHHPERFLHNQDDDDKPD

SEQ ID NO: 252 - DNA, 951 bp, Mycobacterium tuberculosis
gtgtccacccgccaggccgccgaagccgacctggccggcaaagccgctcaatatcgtcccgacgagctggcccgctacgcccagcgggtcatggactggctacaccccgacggcgacctcaccgacaccgaacgcgcccgcaaacgcggcatcaccctgagcaaccagcaatacgacggcatgtcacggctaagtggctacctgaccccccaagcgcgggccacctttgaagccgtgctagccaaactggccgcccccggcgcgaccaaccccgacgaccacaccccggtcatcgacaccacccccgatgcggccgccatcgaccgcgacacccgcagccaagcccaacgcaaccacgacgggctgctggccgggctgcgcgcgctgatcgcctccgggaaactgggccaacacaacggtcttcccgtctcgatcgtggtcaccaccaccctgaccgacctgcaaaccggcgccggcaagggcttcaccggcggcggcaccctgctacccatggccgatgtgatccgcatgaccagccacgcccaccactactcccccgcaagcgggaggtacccccaggcgatcttcgaccacggcacacccctggcgctgtatcacaccaaacgcctagcctccccggcccagcggatcatgctgttcgccaacgaccgcggctgcaccaaacccggctgtgacgcaccggcctaccacagccaagcccaccacgtcaccgcctggaccagcaccggacgcaccgacatcaccgagctgaccctggcctgcggccccgacaaccgactcgccgaaaaaggctggaccacccacaacaacacccacggccacaccgaatggctaccaccaccccacctcgaccacggccaaccccgcaccaacaccttccaccaccccgaacgattcctccacaaccaagacgacgacgacaaacccgat

SEQ ID NO: 253 - protein, 373 aa, Mycobacterium tuberculosis
MDFTTTEAAQDLGGLVDTIVDAVCTPEHQRELDKLEQRFDRELWRKLIDAGILSSAAPESLGGDGFGVLEQVAVLVALGHQLAAVPYLESVVLAAGALARFGSPELQQGWGVSAVSGDRILTVALDGEMGEGPVQAAGTGHGYRLTGTRTQVGYGPVADAFLVPAETDSGAAVFLVAAGDPGVAVTALATTGLGSVGHLELNGAKVDAARRVGGTDVAVWLGTLSTLSRTAFQLGVLERGLQMTAEYARTREQFDRPIGSFQAVGQRLADGYIDVKGLRLTLTQAAWRVAEDSLASRECPQPADIDVATAGFWAAEAGHRVAHTIVHVHGGVGVDTDHPVHRYFLAAKQTEFALGGATGQLRRIGRELAETPA

SEQ ID NO: 254 - DNA, 1119 bp, Mycobacterium tuberculosis
atggatttcacgacaaccgaagccgcccaggatcttggtggtctggtcgacaccatcgtggacgcggtgtgcacgccggagcatcaacgtgagctggacaagctcgagcagcggttcgaccgcgagctgtggcgcaagctgatagacgccggcatcctgtccagtgcggcgccggagtcgctgggcggcgatggcttcggcgtgctcgagcaggttgcggtgctggtggcgttggggcatcaactggccgcggtgccgtacctggagtcggtggtgctcgccgccggcgccctggcccggttcggctcgccggaactgcagcagggctggggggtgtcggcggtctccggcgatcggatcctcaccgtcgccctcgacggtgagatgggcgagggtccggtgcaggccgccggcaccggacatggctaccgcctcaccggcacacgcacccaggtcgggtacggcccggtggccgacgcatttctggtacccgccgaaaccgattccggtgcagccgttttcctggttgccgccggcgacccaggggttgcggtgaccgcactggccaccaccggactgggcagcgtcggacacctcgagctaaacggggccaaagtggacgccgcccgcagggtcggcggaaccgatgtcgcggtttggctcggcacgctttccaccctgagccgcaccgcttttcagctcggtgtgctcgagcgcggactgcaaatgacggccgaatatgcgcgcacccgtgaacaattcgaccgcccgatcggcagcttccaggcggtggggcaacggttggctgacggctacatcgacgtcaagggattgcgactgacgcttacccaggcggcctggcgggtggccgaagattccctggcaagccgggagtgcccccagccagccgacatcgacgtcgccaccgcggggttctgggccgccgaagccgggcatcgggtggcgcataccatcgtgcatgtgcatggcggcgtcggcgtcgacaccgatcatcccgtacaccggtatttcctggccgccaagcagaccgagttcgcgttgggcggcgccaccggtcagctccgccgaatcggccgtgaactggcggaaacccctgcc

SEQ ID NO: 255 - protein, 386 aa, Mycobacterium tuberculosis
VLSGQAAIVGIGATDFSKNSGRSELRLAAEAVLDALADAGLSPTDVDGLTTFTMDTNTEIAVARAAGIGELTFFSKIHYGGGAACATVQHAAMAVATGVADVVVAYRAFNERSGMRFGQVQTRLTENADSTGVDNSFSYPHGLSTPAAQVAMIARRYMHLSGATSRDFGAVSVADRKHAANNPKAYFYGKPITIEDHQNSRWIAEPLRLLDCCQETDGAVAIVVTSAARARDLKQRPVVIEAAAQGCSPDQYTMVSYYRPELDGLPEMGLVGRQLWAQSGLTPADVQTAVLYDHFTPFTLIQLEELGFCGKGEAKDFIADGAIEVGGRLPINTHGGQLGEAYIHGMNGIAEGVRQLRGTSVNPVAGVEHVLVTAGTGVPTSGLILG

SEQ ID NO: 256 - DNA, 1158 bp, Mycobacterium tuberculosis
gtgttatcgggtcaggcggccatcgtcggtatcggcgccaccgacttttcgaagaactccggtcgaagtgagctgcggctggcggccgaggcggtgttggatgcgttggccgatgcgggcctgagcccgaccgatgtcgacgggctgaccacgttcacgatggacaccaacaccgaaatcgccgtggcgcgtgcggccggcatcggcgagctgacgttcttctccaagatccactacggcggtggcgccgcatgtgcgaccgtgcagcacgccgctatggcagtggccaccggggtggctgacgtcgtggtggcgtatcgggcattcaacgaacgatccggcatgcggttcggtcaggtgcaaactcgtttgaccgagaatgccgactccaccggcgtggacaattcgttttcgtatccgcacgggctctccacgcccgccgcgcaagtggcgatgatcgctcgccggtacatgcacctgtctggtgcgaccagccgggacttcggtgctgtctcggtggccgaccgcaagcatgccgccaacaaccccaaggcgtacttctacggcaagccgataaccattgaggaccaccagaattcgaggtggatcgccgagccgctgcggctgctggactgctgccaggagaccgacggcgcggtcgcgatcgtggtgacgtcagctgcgcgcgcacgggacctcaagcagcgcccggtggtcattgaggcggctgcgcagggctgcagtccagaccagtacacgatggtcagctactaccggccggaactcgacggcctgcccgagatgggcctggtgggccggcagctatgggcgcagtcggggctgacgccggccgatgtccagaccgcagtcctctacgaccacttcacgccgtttaccctgattcagttggaggagttgggattctgcggcaagggcgaagcgaaagacttcatcgccgacggcgcgatcgaggtgggcgggcggctgcccatcaacacccacggcggtcaactcggcgaagcctacatccatggcatgaacggcatcgcggagggggtgcggcagctgcgcggcacctcggtgaacccggtggcgggcgtcgagcatgtgctcgtcaccgcgggcaccggggtgcctacgtccgggctgatcctgggt

SEQ ID NO: 257 - protein, 391 aa, Mycobacterium tuberculosis
MGYPVIVEATRSPIGKRNGWLSGLHATELLGAVQKAVVDKAGIQSGLHAGDVEQVIGGCVTQFGEQSNNISRVAWLTAGLPEHVGATTVDCQCGSGQQANHLIAGLIAAGAIDVGIACGIEAMSRVGLGANAGPDRSLIRAQSWDIDLPNQFEAAERIAKRRGITREDVDVFGLESQRRAQRAWAEGRFDREISPIQAPVLDEQNQPTGERRLVFRDQGLRETTMAGLGELKPVLEGGIHTAGTSSQISDGAAAVLWMDEAVARAHGLTPRARIVAQALVGAEPYYHLDGPVQSTAKVLEKAGMKIGDIDIVEINEAFASVVLSWARVHEPDMDRVNVNGGAIALGHPVGCTGSRLITTALHELERTDQSLALITMCAGGALSTGTIIERI

SEQ ID NO: 258 - DNA, 1173 bp, Mycobacterium tuberculosis
atgggttacccggtcatcgttgaagccacccgcagccccatcggcaaacgcaacggatggctgtcggggctgcatgccaccgagttgttgggcgcggtgcaaaaggcggtggtcgacaaggccggcatccagtccggccttcacgccggtgacgtcgaacaggtcatcggcggttgcgtgacccagttcggggagcaatccaacaacatcagccgggtggcctggctgacggccggtttgcccgaacacgtcggcgccaccaccgtcgactgccagtgcggcagcggccagcaggccaaccatctgattgccgggttgatcgcggccggtgccatcgatgtcggcatcgcctgcggcatcgaggcgatgagccgggtcgggctgggcgccaacgccgggccggaccgctcgctgatccgcgcgcagtcatgggatatcgacctgccgaaccagttcgaggccgccgagcggatcgccaagcggcgcggcatcacccgcgaggacgtggatgtcttcgggctcgagtcgcagcgacgcgcgcagcgggcctgggcggagggccgctttgaccgcgagatctcgccgatccaggcgccggtgctcgacgagcagaatcagcccaccggcgagcggcgcctggtctttcgcgaccagggcctgcgcgagaccacgatggcggggctaggcgagctgaaaccggtgctcgagggcggcatccacaccgcgggcacgtcgtcgcagatctccgacggcgcggcagccgtgttgtggatggacgaagccgtggcacgtgcgcacggcctgaccccgcgggcccggatcgtcgcccaggcactcgtcggcgccgagccctactaccacctggacggcccggtgcagtccaccgcgaaggtgctggagaaggccggcatgaagatcggcgacatcgacatcgtcgagatcaacgaggcgttcgcgtccgtggtgctgtcctgggcgcgggtgcacgagcccgacatggaccgggtcaacgtcaacggcggggcgatcgcgctggggcatccggtgggctgcaccggcagccggctgatcaccaccgccctgcacgagctcgagcgcaccgaccagagcctcgcgctgatcaccatgtgcgccggcggggccctgtccaccggcaccatcatcgagcggatt

SEQ ID NO: 259 - protein, 247 aa, Mycobacterium tuberculosis
MPITSTTPEPGIVAVTVDYPPVNAIPSKAWFDLADAVTAAGANSDTRAVILRAEGRGFNAGVDIKEMQRTEGFTALIDANRGCFAAFRAVYECAVPVIAAVNGFCVGGGIGLVGNSDVIVASEDATFGLPEVERGALGAATHLSRLVPQHLMRRLFFTAATVDAATLQHFGSVHEVVSRDQLDEAALRVARDIAAKDTRVIRAAKEALNFIDVQRVNASYRMEQGFTFELNLAGVADEHRDAFVKKS

SEQ ID NO: 260 - DNA, 741 bp, Mycobacterium tuberculosis
atgccgatcacctccaccacgcccgaaccgggcatcgtcgcggtcaccgtcgactacccgccggtcaacgccatcccgtcgaaagcgtggttcgacctggccgacgcggtgacggccgcgggcgccaactccgacacccgcgcggtgatcctgcgggccgaggggcgcggcttcaacgccggggtggacatcaaagagatgcaacgaaccgaaggtttcacggcgctgatcgacgccaaccgcggctgcttcgccgcattccgcgccgtctacgagtgcgcggtgccggtgatcgccgccgtgaacggattctgcgtgggcggcggcatcggcctggtcggcaactccgacgtcatcgtggcctccgaggacgccaccttcggcctgcccgaggtggaacggggcgcgctgggcgcggccacgcacctctcgcggctggtgccccagcacctgatgcgacggctgttctttacggcggccaccgtggacgcggccaccttgcagcacttcggctcggtgcacgaggtggtgtcccgcgatcagctggacgaggccgctttgcgggtggcccgcgacatcgccgccaaagacacccgggtcatccgcgccgccaaggaggcgctgaacttcatcgacgtgcaacgggtcaatgcgagttaccggatggagcaaggttttaccttcgagctcaacctcgccggagtcgccgacgagcaccgcgacgcctttgtgaagaagtca

SEQ ID NO: 261 - protein, 250 aa, Mycobacterium tuberculosis
VSTRAEVCAVACAELFRDAGEIMISPMTNMASVGARLARLTFAPDILLTDGEAQLLADTPALGKTGAPNRIEGWMPFGRVFETLAWGRRHVVMGANQVDRYGNQNISAFGPLQRPTRQMFGVRGSPGNTINHATSYWVGNHCKRVFVEAVDVVSGIGYDKVDPDNPAFRFVNVYRVVSNLGVFDFGGPDHSMRAVSLHPGVTPGDVRDATSFEVHDLDAAEQTRLPTDDELHLIRAVIDPKSLRDREIRS

SEQ ID NO: 262 - DNA, 750 bp, Mycobacterium tuberculosis
gtgagcacccgagccgaagtgtgtgccgtcgcctgcgccgagttgttccgcgatgcaggcgaaatcatgatcagccccatgaccaacatggcctcggtaggggcgcggctggcgcggctcaccttcgcgccggacattctgctgaccgacggcgaggctcagctgctcgcggacacaccggcattgggcaagacgggcgccccaaacaggattgaggggtggatgccgttcggccgggttttcgaaaccctggcctgggggcgccggcacgtggtgatgggcgccaatcaggtcgaccgctatggcaatcagaacatctcggcgttcgggccgctgcagcggccgacccggcagatgttcggcgtccgcggctcgccgggcaacaccatcaaccacgccaccagttactgggtgggcaaccactgcaagcgggtctttgtcgaggccgtcgatgtggtctccggcatcggctacgacaaggtggatccggacaatccggccttccggttcgtcaacgtctaccgggtggtgtccaacctaggcgtgttcgacttcggcggccccgaccactccatgcgggcggtatccctacaccccggggtgacgcccggcgacgtccgcgacgccacctcgttcgaggtgcatgacctcgacgcggccgagcagaccaggctgcccaccgacgacgaactgcacctgatccgcgcggtaatcgatccgaagtcgttgcgggacagggagatacgatca

SEQ ID NO: 263 - protein, 388 aa, Mycobacterium tuberculosis
VTDRVALRAGVPPFYVMDVWLAAAERQRTHGDLVNLSAGQPSAGAPEPVRAAAAAALHLNQLGYSVALGIPELRDAIAADYQRRHGITVEPDAVVITTGSSGGFLLAFLACFDAGDRVAMASPGYPCYRNILSALGCEVVEIPCGPQTRFQPTAQMLAEIDPPLRGVVVASPANPTGTVIPPEELAAIASWCDASDVRLISDEVYHGLVYQGAPQTSCAWQTSRNAVVVNSFSKYYAMTGWRLGWLLVPTVLRRAVDCLTGNFTICPPVLSQIAAVSAFTPEATAEADGNLASYAINRSLLLDGLRRIGIDRLAPTDGAFYVYADVSDFTSDSLAFCSKLLADTGVAIAPGIDFDTARGGSFVRISFAGPSGDIEEALRRIGSWLPSQ

SEQ ID NO: 264 - DNA, 1164 bp, Mycobacterium tuberculosis
gtgacggatcgtgtcgccctgcgtgccggcgttcccccgttctacgtgatggacgtctggttggcggccgcggagcgccagcgcacccatggggatctggtgaatctttcggcgggccaacccagtgcgggcgctccggaaccggtgcgtgcggccgcggccgccgccctgcatctcaaccagttgggatactcggtggcgctgggtattccggagctgcgcgacgctatcgccgcggattaccaacgccggcatggcatcaccgtcgaacccgatgcggtggtgatcaccacgggctcctcgggcggctttctgctcgcgtttctggcgtgcttcgacgccggtgatcgggtcgcgatggccagtcccggctacccgtgctaccggaatatcctgtcagcgctgggatgtgaggtcgtggagatcccgtgcggaccgcagacccgattccaaccgaccgcgcagatgctggccgagatcgacccaccgctgcgcggtgtcgtcgtcgccagcccggccaacccgaccggaaccgtcatcccgcccgaagaactggcggccatcgcgtcgtggtgtgacgcatcggatgtccggttgatcagtgatgaggtctaccacggcctggtgtaccagggggcaccgcaaaccagctgcgcctggcagacgtcgcgaaacgcggtggtagtcaacagcttttccaagtattacgcgatgacgggctggcggctgggctggctgctggtgccgacggtgctgcgccgcgcggtggactgcctgaccggcaacttcaccatctgcccgccggtcttgtcgcagatcgccgcggtgtccgcgttcaccccggaggcgaccgccgaggccgacggcaacctggccagctacgcgatcaaccgctcgctgttgctggacggtctgcgtcgcatcggcatcgaccggctggcacccaccgacggcgcattctacgtctacgccgacgtctcggacttcaccagcgattcgctggccttctgctcaaagttgctggccgacaccggtgttgcgatcgcacccggaatcgatttcgacaccgcacgggggggttcgtttgttcggatatcgtttgccgggccaagcggcgacatcgaagaagccttacggcgcatcggctcctggctgccgagccaa

SEQ ID NO: 265 - protein, 291 aa, Mycobacterium tuberculosis
MTATEELTFESTSRFAEVDVDGPLKLHYHEAGVGNDQTVVLLHGGGPGAASWTNFSRNIAVLARHFHVLAVDQPGYGHSDKRAEHGQFNRYAAMALKGLFDQLGLGRVPLVGNSLGGGTAVRFALDYPARAGRLVLMGPGGLSINLFAPDPTEGVKRLSKFSVAPTRENLEAFLRVMVYDKNLITPELVDQRFALASTPESLTATRAMGKSFAGADFEAGMMWREVYRLRQPVLLIWGREDRVNPLDGALVALKTIPRAQLHVFGQCGHWVQVEKFDEFNKLTIEFLGGGR

SEQ ID NO: 266 - DNA, 873 bp, Mycobacterium tuberculosis
atgacagctaccgaggaattgacgttcgaatccacctcgcgctttgcggaagtggacgtcgacgggccgctgaaactgcactaccacgaggccggcgtgggcaacgaccagacggtggtgctactgcacggcggtgggcccggcgcggcgagctggacgaacttctcgcgtaatatcgcggtgctggcgcggcactttcatgtgctggccgtcgaccagcccggttacggccattccgacaagcgggccgagcacggccagttcaatcgctatgccgcgatggcgctgaaggggctcttcgatcagctggggctggggcgggtaccgctggtgggcaactcgttgggcgggggaaccgcggtccggtttgcgctggactacccggcccgggcaggacggttagtgctgatgggcccggggggcctgagtatcaacctgtttgcgcccgacccgaccgagggagtcaaacggctgtcgaagttctccgttgcgcccacccgggagaacctcgaggcgttcctgcgggtcatggtctacgacaagaacctgatcacccccgagttggtggatcagcggtttgcgctggccagcaccccggagtcgttgacggcaacacgggcgatgggaaagtcgttcgccggagccgacttcgaggccggcatgatgtggcgcgaggtgtatcggctgcgccagccggtgttgctgatctggggtcgtgaggaccgggtcaacccgctggacggcgcgctggttgcgttgaaaacgattccgcgtgcgcagctgcacgtattcgggcagtgtgggcattgggtgcaggtggagaagttcgacgagttcaacaagctgacgattgaatttctgggaggtggcaga

SEQ ID NO: 267 - protein, 188 aa, Mycobacterium tuberculosis
MTRVVLSVGSNLGDRLARLRSVADGLGDALIAASPIYEADPWGGVEQGQFLNAVLIADDPTCEPREWLRRAQEFERAAGRVRGQRWGPRNLDVDLIACYQTSATEALVEVTARENHLTLPHPLAHLRAFVLIPWIAVDPTAQLTVAGCPRPVTRLLAELEPADRDSVRLFRPSFDLNSRHPVSRAPES

SEQ ID NO: 268 - DNA, 564 bp, Mycobacterium tuberculosis
atgacgcgggtagtgctctcggttggctccaacctgggtgaccgcctggcacgattgcggtcggtcgccgacggtctcggcgatgcgttgattgcggcttccccgatatatgaggccgacccctggggtggggtggagcaggggcagttcctcaatgcggtgctgatcgccgacgatcctacctgcgaaccgcgggagtggctgcggcgggcgcaggagttcgagcgcgctgcgggcagggtgcgtggccagcgctggggtccacgaaatctcgacgtcgacctgatcgcctgctaccagacctcggccaccgaggctctggtcgaagtgaccgcgcgggagaaccacctcacgctgccgcacccactggcgcatctgcgggcctttgtgttgatcccgtggattgccgtcgacccaacggcgcagctgacggttgccgggtgcccgcggcccgtcacgcgactgctggccgagctggagcccgccgaccgcgacagtgtgcggttgtttaggccgtcgttcgatctgaatagcagacaccccgtcagtcgggcaccggaaagc

SEQ ID NO: 269 - protein, 166 aa, Mycobacterium tuberculosis
LPGRVFASPADFNTQLQAWLVRANHRQHRVLGCRPADRIEADTAAMLTLPPVGPSIGWRTSTRLPRDHYVRLDGNDYSVHPVAIGRRIEITADLSRVRVWCGGTLVADHDRIWAKHQTISDPEHVVAAKLLRRKRFDIVGPPHHVEVEQRLLTTYDTVLGLDGPVA

SEQ ID NO: 270 - DNA, 498 bp, Mycobacterium tuberculosis
ttgccgggtcgggtctttgcctctccggcggatttcaatacccagttgcaggcctggctggtgcgggccaatcaccgccagcaccgagtgctgggatgtcgaccggcagatcgcatcgaggccgataccgcagcgatgctgacattgccgccggtcgggcccagcatcgggtggcgaacctcgacacggctgccgcgcgatcattacgtgcgcctcgacggcaacgactactcggtgcatccggtcgcgatcggccggcgcatcgagatcaccgcagatctgagccgggtccgggtctggtgtggcggcaccctggtcgccgatcatgaccgcatctgggccaaacaccagacgatcagcgatcccgagcatgtcgtggccgccaaactgctgcgacgcaaacggttcgacatcgtcggtccaccccaccacgttgaggtcgaacaacgtctcctgaccacctacgacaccgtgttgggccttgacgggccggtggcc

SEQ ID NO: 271 - protein, 350 aa, Mycobacterium tuberculosis
MLTDPGLRDELDRVAAAVGVRVVHLGGRHPVSRKTWSAAAAVVLDHAAADRCGRLALPRRTHVSVLTGTEAATATWAAAITVGAQHVLRMPEQEGELVRELAEAAESARDDGICGAVVAVIGGRGGAGASLFAVALAQAAADALLVDLDPWAGGIDLLVGGETAPGLRWPDLALQGGRLNWSAVRAALPRPRGISVLSGTRRGYELDAGPVDAVIDAGRRGGVTVVCDLPRRLTDATQAALDAADLVVLVSPCDVRACAAAATMAPVLTAINPNLGLVVRGPSPGGLRAAEVADVAGVPLLASMRAQPRLAEQLEHGGLRLRRRSVLASAARRVLGVLPRAGSGRHGRAA

SEQ ID NO: 272 - DNA, 1050 bp, Mycobacterium tuberculosis
atgctgaccgatccggggttgcgcgacgagctggaccgagtcgccgcagccgtcggggttcgcgttgttcatctcggcggccgccatccggtgagcagaaagacgtggtcggcggcggcggctgtggtgctcgaccacgcggcggcggaccggtgtgggcggctcgcgctaccccggcgcacccacgtcagcgtgttgaccggaaccgaagccgcgacggcgacctgggcggctgccataaccgtcggggcccagcacgtgctgaggatgcccgagcaggagggtgaactggtccgcgagctcgccgaagctgctgaatcggcacgcgatgacgggatctgcggggcggtggtcgcggtcatcgggggtcgcggtggcgctggggcatcgttgtttgcggttgccctggcgcaggccgccgctgatgcgctgttggtcgatctcgatccgtgggccggcggcatcgatcttctggtgggcggcgaaaccgcccccggtctgcgttggcccgacctggcgctacagggtggacggctgaattggtcggcggtgcgtgcggcattgccgcgaccgcgggggatcagcgtgctctcgggaactcggcgcggctacgagttagacgccgggccggtggacgccgtgatcgacgccggccgacgtgggggagtcaccgtggtctgcgatcttccacgtcgtctgaccgatgccacccaagcagcgctggatgccgccgatctcgtcgtcctggtcagcccatgcgatgtgcgggcatgtgcggccgccgcgacgatggcgcctgtgctgaccgcgatcaaccccaacctgggtctggtggtgcgggggccctccccggggggattgcgggcggcagaggtcgcggacgtcgccggggtgccgctactggcatccatgagggcccagccgcggctagccgaacagctggaacacgggggtcttcgactgcgacggcgatcggtgctggcatcggctgcccgacgggtacttggtgtgctgccacgtgctgggtcagggcgacacggtagggcggca

SEQ ID NO: 273 - protein, 70 aa, Mycobacterium tuberculosis
MSDCNVLGGALEQGGTDPLTGFYRDGCCATGPEDLGWHTICAVMTTEFLAHQRSVGNDLSIARPPRWLRP

SEQ ID NO: 274 - DNA, 210 bp, Mycobacterium tuberculosis
atgtccgattgcaatgtgctgggcggcgccctggaacagggtggcaccgatccgcttaccggcttctatcgtgacggctgctgtgcgaccggacccgaggacctcggttggcacaccatctgcgccgtcatgaccaccgaattcctggcacaccagcgctcggtcggcaacgacctgtcgattgcgcgcccgccacggtggctgcgccct

SEQ ID NO: 275 - protein, 846 aa, Mycobacterium tuberculosis
MAPLAVDPAALDSAGGAVVAAGAGLGAVISSLTAALAGCAGMAGDDPAGAVFGRSYDGSAAALVQAMSVARNGLCNLGDGVRMSAHNYSLAEAMSDVAGRAAPLPAPPPSGCVGVGAPPSAVGGGGGAPKGWGWVAPYIGMIWPNGDSTKLRAAAVAWRSAGTQFALTEIQSTAGPMGVIRAQQLPEAGLIESAFADAYASTTAVVGQCHQLAAQLDAYAARIDAVHAAVLDLLARICDPLTGIKEVWEFLTDQDEDEIQRIAHDIAVVVDQFSGEVDALAAEITAVVSHAEAVITAMADHAGKQWDRFLHSNPVGVVIDGTGQQLKGFGEEAFGMAKDSWDLGPLRASIDPFGWYRSWEEMLTGMAPLAGLGGENAPGVVESWKQFGKSLIHWDEWTTNPNEALGKTVFDAATLALPGGPLSKLGSKGRDILAGVRGLKERLEPTTPHLEPPATPPRPGPQPPRIEPPESGHPAPAPAAKPAPVPANGPLPHSPTESKPPPVDRPAEPVAPSSASAGQPRVSAATTPGTHVPHGLPQPGEHVPAQAPPATTLLGGPPVESAPATAHQPQWATTPAAPAAAPHSTPGGVHSTESGPHGRSLSAHGSEPTHDGASHGSGHGSGSEPPGLHAPHREQQLAMHSNEPAGEGWHRLSDEAVDPQYGEPLSRHWDFTDNPADRSRINPVVAQLMEDPNAPFGRDPQGQPYTQERYQERFNSVGPWGQQYSNFPPNNGAVPGTRIAYTNLEKFLSDYGPQLDRIGGDQGKYLAIMEHGRPASWEQRALHVTSLRDPYHAYTIDWLPEGWFIEVSEVAPGCGQPGGSIQVRIFDHQNEMRKVEELIRRGVLRQ

SEQ ID NO: 276 - DNA, 2538 bp, Mycobacterium tuberculosis
atggcgccgttggcggtcgatcccgcggcccttgatagcgcgggcggcgcggtggtggctgcgggtgcgggtttgggtgcggtgatctcgtcgctgaccgcggcgctggccgggtgtgcggggatggccggtgatgatccggctggggcggtgttcgggcgctcctatgacggttcggcggccgcgctggtgcaggcgatgtcggtggcgcgcaacggattgtgcaacctcggcgatggggtgcgcatgagcgcgcacaactactcgttggccgaggcgatgtcggatgtcgctgggcgggcggcgccgttgccggcgccgccgccgagcggctgtgtcggcgtgggtgcgccgccgtcggcggtcggtggcggcggtggcgccccgaagggctgggggtgggtggccccgtatatcgggatgatctggccgaacggggattcgacaaagctacgtgcggcggctgtggcgtggcgcagcgcgggcacgcagttcgcgctgactgagattcagtcgacggcggggccgatgggcgttattcgcgcccagcagctcccggaggcggggctgatcgagtcggcgtttgctgacgcgtacgccagcaccaccgctgtcgtgggccaatgccaccagctggcggcccagctagacgcctatgccgcccgcatcgacgcggtgcatgcggcggtcctggatttgttggcccgcatctgcgatccgctgaccgggatcaaagaggtgtgggagtttctgaccgaccaggacgaagacgagatccagcgcatcgcccatgacatcgcggtggtggtcgaccagttcagcggggaagtggacgcgttggctgcggagatcaccgcggtggtgtcgcacgccgaggcggtgatcaccgcgatggcagaccacgcaggcaaacaatgggatcggttcttgcacagcaacccggtgggtgtggtcatcgatggcaccgggcagcagctcaaaggcttcggcgaggaggccttcgggatggccaaggactcctgggacctagggccactgcgcgcctcgatagacccgttcgggtggtatcgctcctgggaggagatgctgactgggatggcgccgctggcgggcctgggcggcgagaacgctcccggcgttgtggagtcgtggaagcagttcggcaaaagcctcatccattgggatgagtggacgaccaaccctaatgaggcgctaggcaagaccgtattcgacgccgcgacgctagctttgccgggcgggccgctgtcgaaacttggcagcaagggccgcgacattctcgcgggcgtgcgaggcctcaaggagcggcttgagccgacgacaccgcaccttgagcccccagcaacgccgccgcggccaggaccgcaaccaccacggatcgaaccaccagaatcgggccacccggcacccgcgcccgcggcgaaaccggcgcccgtgcccgccaacggtccactgccgcacagccccaccgaatccaaaccgccgcccgtcgacagaccggctgaaccggtggcgccgtcgtcggcgtcggcaggccagccccgggtatccgcagccaccacgcccggcacacatgtgccgcatggcctgccgcaaccgggtgaacatgtcccggcgcaagcaccaccggcgacgacgttgcttggcggacctcctgtcgagtcagcgcccgctaccgcgcaccaaccccagtgggcgaccacaccagcagcacccgcggcggcgccgcattccacgcccggaggcgttcactcaaccgaatcggggcctcacggccgatcactgagcgcacacggatccgagccgacccacgacggtgcgtctcacgggtcaggccacggtagcggtagcgagccacctgggctgcatgcgccgcatcgcgagcagcagcttgcaatgcattcgaacgaaccagctggagagggttggcatcggttatccgacgaagcggttgacccgcagtatggcgagccattatcgcgccactgggactttacagacaatccggccgatcgcagtcggataaacccggttgtggcccagctcatggaggaccccaacgccccattcggccgcgatcctcagggacagccctatacccaagaacggtatcaagagcgatttaatagtgtaggcccatggggccagcagtactctaattttccgcctaacaatggtgcggttccagggacaaggatcgcctacactaatctcgaaaaatttcttagtgactacggcccccagctagatcgtataggcggcgatcagggcaagtacctggcgatcatggaacatgggcgcccggcatcatgggaacaacgtgccctgcacgtgacgtcgttacgcgacccctaccacgcgtataccattgattggttgcctgagggatggttcatcgaagtatctgaggtcgcgccggggtgcggccagccgggcggatccatccaagtgcggatattcgatcatcagaacgagatgcgcaaagtggaagagttaataaggcgcggggtgttgcgacag

SEQ ID NO: 277 - protein, 115 aa, Mycobacterium tuberculosis
MFLAGVLCMCAAAASALFGSWSLCHTPTADPTALALRAMAPTQLAAAVMLAAGGVVAVAAPGHTALMVVIVCIAGAVGTLAAGSWQSAQYALRRETASPTANCVGSCAVCTQACH

SEQ ID NO: 278 - DNA, 345 bp, Mycobacterium tuberculosis
atgttcctcgcgggtgtgctgtgcatgtgtgcggcggcggcgtccgccctgttcgggagctggtcgctgtgccatacgcccactgccgaccccacggcgctggcgctgcgcgcgatggcgcccacgcagttggcagccgcagtaatgctggccgccgggggagtggtggcggtggccgcgcccgggcacaccgccttgatggtggtgatcgtctgcattgcgggcgcggtcggcacgctggccgcggggtcgtggcagagcgcccagtacgcgctgcgccgtgaaaccgctagccccaccgccaactgcgttggcagctgcgcggtctgcacccaggcctgtcat

SEQ ID NO: 279 - protein, 236 aa, Mycobacterium tuberculosis
MGGMDTGVTSPRVLVVDDDSDVLASLERGLRLSGFEVATAVDGAEALRSATENRPDAIVLDINMPVLDGVSVVTALRAMDNDVPVCVLSARSSVDDRVAGLEAGADDYLVKPFVLAELVARVKALLRRRGSTATSSSETITVGPLEVDIPGRRARVNGVDVDLTKREFDLLAVLAEHKTAVLSRAQLLELVWGYDFAADTNVVDVFIGYLRRKLEAGGGPRLLHTVRGVGFVLRMQ

SEQ ID NO: 280 - DNA, 708 bp, Mycobacterium tuberculosis
atgggcggcatggacactggtgtgacctcacctcgggtgttggtcgtcgacgacgactccgatgtgctcgcctcgctggaacgcggcttacggctgtccggattcgaggtagcgaccgcggtggacggcgccgaggccttgcgcagcgccaccgagaaccggccggacgcgatcgtgctcgacatcaacatgccagtgctcgatggagtcagcgtcgtgacggcactacgcgcgatggacaacgacgtcccggtctgtgtgctatccgcacgcagctctgtcgatgaccgagtggccggattggaggccggcgccgacgattacctggtgaaaccgttcgtgctggccgagctggtggcacgggtgaaggcgctgctgcgccgccgcggctccactgcaacgtcgtcctcggaaaccatcacggtgggcccgctggaggtggacatccccggccggcgggcccgggtcaacggcgtcgacgtcgacctgaccaagcgcgaattcgacctgctcgcggtgctggccgagcacaagaccgcggtgctctcccgagcgcaactcctggaattggtgtggggctacgacttcgccgccgacaccaacgtggtggacgtcttcatcgggtacctgcggcgcaaactggaggccggcggtggccctaggctgctgcataccgtccgcggagtcggattcgtgctgcgtatgcag

SEQ ID NO: 281 - protein, 112 aa, Mycobacterium tuberculosis
MAALVREVVGDVLRGARMSQGRTLREVSDSARVSLGYLSEIERGRKEPSSELLSAICTALQLPLSVVLIDAGERMARQERLARATPAGRATGATIDASTKVVIAPVVSLAVA

SEQ ID NO: 282 - DNA, 336 bp, Mycobacterium tuberculosis
atggcggctttggtgcgtgaggtcgttggtgacgtgctgcgcggagcgcggatgtcgcagggtcggacgctgcgcgaggtgtccgattcggcgcgggtgagcctcgggtatctgtcggagatcgagcgcggtcgcaaggagccttccagcgagctgctcagtgcgatttgtacggctctgcagctcccgttgtcggtggtgctcatcgatgcgggcgagcggatggcgcgtcaagagcgccttgcccgcgccaccccggctggcagagcaaccggcgccaccattgacgccagcaccaaggtcgtcattgcgccggtggtgtcgctggcggtggcc

---

The invention claimed is:

1. An isolated *M. tuberculosis* peptide selected from the group consisting of SEQ ID NOs: 7, 55, 125 and 129 or a variant thereof having at least 70% amino acid homology therewith, or a fusion protein thereof, wherein said fusion protein or variant has a common antigenic cross-reactivity to said isolated peptide; wherein the peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

2. A therapeutic agent for combating mycobacterial infections, comprising an *M. tuberculosis* peptide selected from the group consisting of SEQ ID NOs: 7, 55, 125 and 129, or a fusion protein thereof, wherein said fusion protein has a common antigenic cross-reactivity to said peptide; wherein the peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

3. A method of treating an *M. tuberculosis* infection, by administering to a patient an *M. tuberculosis* peptide selected from the group consisting of SEQ ID NOs: 7, 55, 125 and 129, or a fusion protein thereof, wherein said fusion protein has a common antigenic cross-reactivity to said peptide; wherein the peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

4. A method of diagnosing a mycobacterial infection, comprising the steps:

(i) incubating a biological sample with an isolated *M. tuberculosis* peptide selected from the group consisting of SEQ ID NOs: 7, 55, 125 and 129 wherein the peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*; and (ii) detecting antibodies to *mycobacteria*, wherein said antibodies bind to said isolated peptide, and thereby detecting mycobacterial infection.

5. A diagnostic reagent for identifying a mycobacterial infection, comprising an isolated *M. tuberculosis* peptide selected from the group consisting of SEQ ID NOs: 7, 55, 125 and 129, or a fusion protein thereof, wherein said fusion protein has a common antigenic cross-reactivity to said peptide; wherein the peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

6. An isolated peptide, wherein said peptide is:

(i) a fragment of an *M. tuberculosis* peptide selected from the group consisting of SEQ ID NOs: 7, 55, 125 and 129, wherein said fragment has at least 35 amino acids;

(ii) a variant of (i) having at least 70% amino acid homology therewith; or (iii) a fusion protein of (i) or (ii);

wherein said fragment, variant or fusion protein has a common antigenic cross-reactivity to said *M. tuberculosis* peptide; wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

7. A therapeutic agent for combating mycobacterial infections, comprising an isolated peptide, wherein said isolated peptide is:

(i) a variant having at least 90% amino acid homology to a peptide selected from the group consisting of:

(a) an *M. tuberculosis* peptide selected from the group consisting of SEQ ID NOs: 7, 55, 125 and 129; and (b) a fragment of (a) having at least 35 amino acid residues; or (ii) a fusion protein of (i);

wherein said fragment, variant or fusion protein has a common antigenic cross-reactivity to said *M. tuberculosis* peptide; and wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

8. A diagnostic reagent for identifying a mycobacterial infection, comprising an isolated peptide, wherein said isolated peptide is:

(i) a variant having at least 90% amino acid homology to a peptide selected from the group consisting of:

(a) an *M. tuberculosis* peptide selected from the group consisting of SEQ ID NOs: 7, 55, 125 and 129; and (b) a fragment of (a) having at least 35 amino acid residues; or (ii) a fusion protein of (i);

wherein said variant, fragment or fusion protein has a common antigenic cross-reactivity to said *M. tuberculosis* peptide; and wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

9. A therapeutic agent for combating mycobacterial infections, comprising an isolated peptide, wherein said peptide is:

(i) a fragment of an *M. tuberculosis* peptide selected from the group consisting of SEQ ID NOs: 7, 55, 125 and 129, wherein said fragment has at least 35 amino acid residues; or (ii) a fusion protein of (i);

wherein said fragment, or fusion protein has a common antigenic cross-reactivity to said *M. tuberculosis* peptide; wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

10. A method of treating an *M. tuberculosis* infection, by administering to a patient an isolated peptide, wherein said peptide is:

(i) a fragment of an *M. tuberculosis* peptide selected from the group consisting of SEQ ID NOs: 7, 55, 125 and 129, wherein said fragment has at least 35 amino acids; or (ii) a fusion protein of (i);

wherein said fragment or fusion protein has a common antigenic cross-reactivity to said *M. tuberculosis* peptide; wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

11. A method of diagnosing a mycobacterial infection, comprising the steps of:

(i) incubating a biological sample with an isolated peptide, wherein said isolated peptide is a fragment of an *M. tuberculosis* peptide selected from the group consisting of SEQ ID NOs: 7, 55, 125 and 129, wherein said fragment has at least 35 amino acids;

wherein said fragment, has a common antigenic cross-reactivity to said *M. tuberculosis* peptide; wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium;* and (ii) detecting antibodies to *mycobacteria*, wherein said antibodies bind to said fragment, and thereby detecting mycobacterial infection.

12. A diagnostic reagent for identifying a mycobacterial infection, comprising an isolated peptide, wherein said peptide is:

(i) a fragment of an *M. tuberculosis* peptide selected from the group consisting of SEQ ID NOs: 7, 55, 125 and 129, wherein said fragment has at least 35 amino acids; or (ii) a fusion protein of (i);

wherein said fragment or fusion protein has a common antigenic cross-reactivity to said *M. tuberculosis* peptide; wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

13. A medicament for reducing the severity or intensity of a mycobacterial infection, or for preventing mycobacterial disease progression, by administering to a patient an *M. tuberculosis* peptide selected from the group consisting of SEQ ID NOs: 7, 55, 125 or 129, or a fusion protein thereof, wherein said fusion protein has a common antigenic cross-reactivity to said peptide; wherein the peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

14. A method of reducing the severity or intensity of a mycobacterial infection, or of preventing mycobacterial disease progression, by administering to a patient an isolated peptide, wherein said isolated peptide is:

(i) a fragment of an *M. tuberculosis* peptide selected from the group consisting of SEQ ID NOs: 7, 55, 125 and 129, wherein said fragment has at least 35 amino acids; or (ii) a fusion protein of (i);

wherein said fragment or fusion protein has a common antigenic cross-reactivity to said *M. tuberculosis* peptide; and wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

15. An isolated peptide, wherein said peptide is:

(i) a fragment of a polypeptide, wherein said polypeptide is a variant having at least 90% amino acid homology with an isolated *M. tuberculosis* peptide selected from the group consisting of SEQ ID NOs: 7, 55, 125 and 129, wherein said fragment has at least 35 amino acids residues; or (ii) a fusion protein of (i);

wherein said fragment, variant or fusion protein has a common antigenic cross-reactivity to said *M. tuberculosis* peptide; and wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

16. A therapeutic agent for combating mycobacterial infections, comprising an isolated peptide, wherein said isolated peptide is:

(i) a fragment of a polypeptide, wherein said polypeptide is a variant having at least 90% amino acid homology with an isolated *M. tuberculosis* peptide selected from the group consisting of SEQ ID NOs: 7, 55, 125 and 129, wherein said fragment has at least 35 amino acids; or (ii) a fusion protein of (i);

wherein said fragment, variant or fusion protein has a common antigenic cross-reactivity to said isolated *M. tuberculosis* peptide; and wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

17. A diagnostic reagent for identifying a mycobacterial infection, comprising an isolated peptide, wherein said peptide is:

(i) a fragment of a polypeptide, wherein said polypeptide is a variant having at least 90% amino acid homology with an isolated *M. tuberculosis* peptide selected from the group consisting of SEQ ID NOs: 7, 55, 125 and 129, wherein said fragment has at least 35 amino acids; or (ii) a fusion protein of (i);

wherein said fragment, variant or fusion protein has a common antigenic cross-reactivity to said isolated *M. tuberculosis* peptide; and wherein the *M. tuberculosis* peptide is encoded by an *M. tuberculosis* gene the expression of which is induced or up regulated under culture conditions that are nutrient starving and which maintain mycobacterial latency, said conditions being obtainable by batch fermentation of an *M. tuberculosis micobacterium* for at least 40 days post inoculation, when compared with culture conditions that are not nutrient starving and which support exponential growth of said *mycobacterium*.

* * * * *